US012593850B2

(12) United States Patent
Savion et al.

(10) Patent No.: US 12,593,850 B2
(45) Date of Patent: Apr. 7, 2026

(54) BACTERIOPHAGES FOR THE CONTROL OF BACTERIAL SPECK DISEASE

(71) Applicant: EcoPhage Ltd., Nes Ziona (IL)

(72) Inventors: Orly Savion, Ness Ziona (IL); Olga Nissan, Rehovot (IL); Sammy Frenk, Kfar Saba (IL); Rudy Maor, Hethersett (GB); Liat Avrahami-Moyal, Gan Yavne (IL)

(73) Assignee: EcoPhage Ltd., Nes Ziona (IL)

( * ) Notice: Subject to any disclaimer, the term of this patent is extended or adjusted under 35 U.S.C. 154(b) by 0 days.

(21) Appl. No.: 18/684,499

(22) PCT Filed: Aug. 17, 2022

(86) PCT No.: PCT/IL2022/050896
§ 371 (c)(1),
(2) Date: Feb. 16, 2024

(87) PCT Pub. No.: WO2023/021513
PCT Pub. Date: Feb. 23, 2023

(65) Prior Publication Data
US 2024/0324600 A1 Oct. 3, 2024

Related U.S. Application Data

(60) Provisional application No. 63/233,844, filed on Aug. 17, 2021.

(51) Int. Cl.
*A01N 63/40* (2020.01)
*A01P 1/00* (2006.01)
*C12N 7/00* (2006.01)

(52) U.S. Cl.
CPC ............... *A01N 63/40* (2020.01); *A01P 1/00* (2021.08); *C12N 7/00* (2013.01); *C12N 2795/00021* (2013.01); *C12N 2795/00031* (2013.01)

(58) Field of Classification Search
None
See application file for complete search history.

(56) References Cited

U.S. PATENT DOCUMENTS 10,499,651 B2 * 12/2019 Gonzalez ................. C12N 7/00
2008/0124305 A1 5/2008 Jackson et al.

FOREIGN PATENT DOCUMENTS

WO WO 2014/063070 A2 4/2014

OTHER PUBLICATIONS

Database NCBI [Online] Jan. 12, 2016 (Jan. 12, 2016). Pseudomonas phage CHF7, complete genome. GenBank accession No. MN729596. 1. (Year: 2016).*
Hernandez et al. Bacteriophage-Mediated Reduction of Bacterial Speck on Tomato Seedlings. Phage (New Rochelle). Dec. 1, 2020; 1(4):205-212. Epub Dec. 16, 2020. (Year: 2020).*
Whisstock J.C. et al. Prediction of protein function from protein sequence and structure. Q Rev Biophys. Aug. 2003;36(3):307-40. Review. (Year: 2003).*
Database NCBI [Online] Dec. 21, 2018 (Dec. 21, 2018). Pseudomonas phage vB_PaeS_SCUT-S4, complete genome. GeneBank accession No. LN913017.1. URL: https://www.ncbi.nlm.nih.gov/nucleotide/MK165658.1?report=genbank&log$=nuclalign&blast_rank=2&RID=J3KA58WX013. (Dec. 21, 2018).
Database NCBI [Online] Jan. 12, 2016 (Jan. 12, 2016). Pseudomonas phage CHF7, complete genome. GeneBank accession No. MN729596. 1. URL: https://www.ncbi.nlm.nih.gov/nucleotide/MN729596.1?report=genbank&log$=nuclalign&blast_rank=2&RID=J3JF9CUX016. (Jan. 12, 2016).
Flores, O. et al., (2020), "Characterization of Bacteriophages *Pseudomonas syringae* pv. Actinidiae with Potential Use as Natural Antimicrobials in Kiwifruit Plants," Microorganisms, 8(7), 974.# Jun. 29, 2020)).
Hernandez, C. A. et al., (2020), "Bacteriophage-Mediated Reduction of Bacterial Speck on Tomato Seedlings," PHAGE: Therapy, Applications and Research, 1(4), 205-212.Dec. 16, 2020 #).
PCT International Search Report and Written Opinion, PCT Application No. PCT/IL2022/050896, Sep. 29, 2022, 9 pages.

* cited by examiner

*Primary Examiner* — Cynthia E Collins
(74) *Attorney, Agent, or Firm* — Fenwick & West LLP

(57) ABSTRACT

Agricultural compositions are disclosed which comprise at least one isolated bacteriophage capable of infecting the plant pathogen *Pseudomonas syringae* pv. tomato, the at least one bacteriophage having a genomic nucleic acid sequence at least 85% identical to one of the nucleic acid sequence as set forth in SEQ ID NOs: 1-23. The composition comprises no more than 10 different strains of bacteriophage. Uses thereof for treating bacterial speck disease are also disclosed.

10 Claims, 4 Drawing Sheets

Specification includes a Sequence Listing.

BACTERIOPHAGES FOR THE CONTROL OF BACTERIAL SPECK DISEASE

RELATED APPLICATION

This application claims the benefit of priority of U.S. Provisional Patent Application No. 63/233,844 filed on 17 Aug. 2021, the contents of which are incorporated herein by reference in their entirety.

SEQUENCE LISTING STATEMENT

The ASCII file, entitled 93249 SequenceListing.txt, created on August 2022 15, comprising 1,160,062 bytes, submitted concurrently with the filing of this application is incorporated herein by reference.

FIELD AND BACKGROUND OF THE INVENTION

The present invention, in some embodiments thereof, relates to agricultural compositions comprising bacteriophages for the control of plant pathogens.

Bacteriophages are viruses that specifically infect bacteria. The emergence of antibiotic resistance and heavy metal tolerance in recent years resulted in a renewed interest in bacteriophage therapy in multiple fields, including human and livestock health and crop protection.

Within the crop protection disciplines, the prevention and treatment of bacterial diseases represent an increasing challenge. Damage caused by bacterial pathogens result in considerable loss yield which in turn cost farmers billions of dollars in annual revenues. Common agricultural practices include the application of chemical based compounds such as broad-spectrum antibiotics like streptomycin, or copper-based bactericides. However, in recent years the use of these compounds has been restricted in many regions due to their toxicity to plants and the environment along with insufficient efficacy acceptance and poor public opinion.

One major bacterial disease in tomato plants is bacterial speck disease caused by *Pseudomonas syringae* pv. tomato. Pathogen-related diseases can lead to yield losses of up to 60% and cause annual damages estimated in billions of dollars. Bacteria can spread from plant to plant by tools, workers' hands, or through splashing rain or irrigation water. Therefore, a preventative treatment, where the active ingredient (e.g., bacteriophage) is applied prophylactically can be especially useful in preventing and reducing the disease symptoms.

Background art includes U.S. Pat. No. 10,499,651; U.S. patent application Ser. No. 2008/0124305 and International Patent Application No. WO2014/063070. Agriphage™ is a product by Omnilytics which comprises bacteriophages for the control of bacterial spot (XCV) and bacterial speck (PST).

SUMMARY OF THE INVENTION

According to an aspect of the present invention there is provided an agricultural composition comprising:

(i) at least one isolated bacteriophage capable of infecting the plant pathogen *Pseudomonas syringae* pv. tomato, the at least one bacteriophage having a genomic nucleic acid sequence at least 85% identical to the nucleic acid sequence as set forth in SEQ ID NOs: 1, 2, 3, 4, 5, 6, 7 8, 9, 10, 11, 13, 14, 15, 18, 19, 20, 21 or 23; and (ii) an agriculturally acceptable carrier, wherein the composition comprises no more than 10 different strains of bacteriophage.

According to embodiments of the invention, the composition comprises no additional bacteriophage that infect plant pathogens other than *Pseudomonas syringae* pv. tomato.

According to embodiments of the invention, the agricultural further comprises an agent which promotes the growth of a plant or maintains the health of the plant.

According to embodiments of the invention, the agent is selected from the group consisting of a fertilizer, an acaricide, a herbicide, a fungicide, an insecticide, a nematicide, a pesticide, a plant growth regulator, a rodenticide and a nutrient.

According to embodiments of the invention, the agriculturally acceptable carrier comprises at least one agent selected from the group consisting of a stabilizer, a tackifier, a preservative, a carrier, a surfactant, an anticomplex agent and a combination thereof.

According to embodiments of the invention, the at least one bacteriophage capable of infecting *Pseudomonas syringae* pv. tomato comprises at least two non-identical bacteriophages capable of infecting *Pseudomonas syringae* pv. tomato.

According to embodiments of the invention, the agricultural composition comprises:

(i) a first bacteriophage having a genomic nucleic acid sequence at least 85% identical to the nucleic acid sequence as set forth in SEQ ID NO: 7; and (ii) a second bacteriophage having a genomic nucleic acid sequence at least 85% identical to the nucleic acid sequence as set forth in SEQ ID NO: 9.

According to embodiments of the invention, the agricultural composition further comprises a third bacteriophage having a genomic nucleic acid sequence at least 85% identical to the nucleic acid sequence as set forth in SEQ ID NO: 12.

According to an aspect of the present invention there is provided an article of manufacture comprising:

(i) a first bacteriophage capable of infecting the pathogen *Pseudomonas syringae* pv. Tomato, the bacteriophage having a genomic nucleic acid sequence at least 85% identical to the nucleic acid sequence as set forth in SEQ ID NOs: 1, 2, 3, 4, 5, 6, 78, 9, 10, 11, 12, 13, 14, 15, 16, 17, 18, 19, 20; 21, 22 or 23 and (ii) a second, non-identical bacteriophage capable of infecting the pathogen *Pseudomonas syringae* pv. tomato, the bacteriophage having a genomic nucleic acid sequence at least 85% identical to the nucleic acid sequence as set forth in SEQ ID NOs: 1, 2, 3, 4, 5, 6, 7, 8, 9, 10, 11, 12, 13, 14, 15, 16, 17, 18, 19, 20, 21, 22 or 23.

According to embodiments of the invention, the first bacteriophage has a genomic nucleic acid sequence at least 85% identical to the nucleic acid sequence as set forth in 1-11, 13-15, 18-20 and 22-23.

According to embodiments of the invention, the second bacteriophage has a genomic nucleic acid sequence at least 85% identical to the nucleic acid sequence as set forth in 1-11, 13-15, 18-20 and 22-23.

According to embodiments of the invention, the article of manufacture further comprises a third, non-identical bacteriophage capable of infecting the pathogen *Pseudomonas syringae* pv. tomato, the bacteriophage having a genomic nucleic acid sequence at least 85% identical to the nucleic acid sequence as set forth in SEQ ID NOs: 1, 2, 3, 4, 5, 6, 7 8, 9, 10, 11, 12, 13, 14, 15, 16, 17, 18, 19, 20, 21, 22 or 23.

According to embodiments of the invention, the first bacteriophage has a genomic nucleic acid sequence at least 85% identical to the nucleic acid sequence as set forth in SEQ ID NO: 7, the second bacteriophage has a genomic nucleic acid sequence at least 85% identical to the nucleic acid sequence as set forth in SEQ ID NO: 17 and the third bacteriophage has a genomic nucleic acid sequence at least 85% identical to the nucleic acid sequence as set forth in SEQ ID NO: 21.

According to embodiments of the invention, the first bacteriophage has a genomic nucleic acid sequence at least 85% identical to the nucleic acid sequence as set forth in SEQ ID NO: 17, the second bacteriophage has a genomic nucleic acid sequence at least 85% identical to the nucleic acid sequence as set forth in SEQ ID NO: 19 and the third bacteriophage has a genomic nucleic acid sequence at least 85% identical to the nucleic acid sequence as set forth in SEQ ID NO: 20.

According to embodiments of the invention, the first bacteriophage has a genomic nucleic acid sequence at least 85% identical to the nucleic acid sequence as set forth in SEQ ID NO: 7, the second bacteriophage has a genomic nucleic acid sequence at least 85% identical to the nucleic acid sequence as set forth in SEQ ID NO: 9 and the third bacteriophage has a genomic nucleic acid sequence at least 85% identical to the nucleic acid sequence as set forth in SEQ ID NO: 12.

According to an aspect of the present invention there is provided an method of controlling or preventing bacterial speck disease of a tomato plant comprising contacting the tomato plant with at least one bacteriophage in an amount which is effective at infecting the plant pathogen *Pseudomonas syringae* pv. Tomato, the at least one bacteriophage having a genomic nucleic acid sequence at least 85% identical to the nucleic acid sequence as set forth in SEQ ID NOs: 1, 2, 3, 4, 5, 6, 7 8, 9, 10, 11, 12, 13, 14, 15, 16, 17, 18, 19, 20, 21, 22 or 23, thereby controlling or preventing the bacterial speck disease of the tomato plant.

According to embodiments of the invention, the at least one first bacteriophage has a genomic nucleic acid sequence at least 85% identical to the nucleic acid sequence as set forth in 1-11, 13-15, 18-20 and 22-23.

According to embodiments of the invention, the contacting is affected at a seedling phase.

According to embodiments of the invention, the contacting is in the soil in the vicinity of or onto: a root, a stem, a seed, a fruit, a flower, a leaf, or any combination thereof.

According to embodiments of the invention, the contacting comprises dipping, spraying or fogging.

According to embodiments of the invention, the at least one bacteriophage comprises at least two bacteriophages, wherein a second of the at least two bacteriophages has a genomic nucleic acid sequence at least 85% identical to the nucleic acid sequence as set forth in SEQ ID NOs: 1, 2, 3, 4, 5, 6, 78, 9, 10, 11, 12, 13, 14, 15, 16, 17, 18, 19, 20, 21, 22 or 23.

According to embodiments of the invention, the at least one bacteriophage comprises at least three bacteriophages, wherein a third of the at least three bacteriophages has a genomic nucleic acid sequence at least 85% identical to the nucleic acid sequence as set forth in SEQ ID NOs: 1, 2, 3, 4, 5, 6, 78, 9, 10, 11, 12, 13, 14, 15, 16, 17, 18, 19, 20, 21, 22 or 23.

According to embodiments of the invention, the first bacteriophage has a genomic nucleic acid sequence at least 85% identical to the nucleic acid sequence as set forth in SEQ ID NO: 7, the second bacteriophage has a genomic nucleic acid sequence at least 85% identical to the nucleic acid sequence as set forth in SEQ ID NO: 17 and the third bacteriophage has a genomic nucleic acid sequence at least 85% identical to the nucleic acid sequence as set forth in SEQ ID NO: 21.

According to embodiments of the invention, the first bacteriophage has a genomic nucleic acid sequence at least 85% identical to the nucleic acid sequence as set forth in SEQ ID NO: 17, the second bacteriophage has a genomic nucleic acid sequence at least 85% identical to the nucleic acid sequence as set forth in SEQ ID NO: 19 and the third bacteriophage has a genomic nucleic acid sequence at least 85% identical to the nucleic acid sequence as set forth in SEQ ID NO: 20.

According to embodiments of the invention, the first bacteriophage has a genomic nucleic acid sequence at least 85% identical to the nucleic acid sequence as set forth in SEQ ID NO: 7, the second bacteriophage has a genomic nucleic acid sequence at least 85% identical to the nucleic acid sequence as set forth in SEQ ID NO: 9 and the third bacteriophage has a genomic nucleic acid sequence at least 85% identical to the nucleic acid sequence as set forth in SEQ ID NO: 12.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings.

DESCRIPTION OF SPECIFIC EMBODIMENTS OF THE INVENTION

Figure 1:
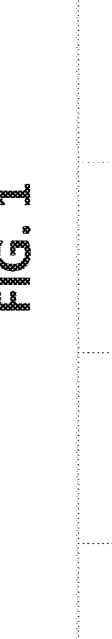
FIG. 1 is a graph illustrating F group single bacteriophage liquid host range targeting Pseudomonas strains (Pst 1-14, 16 and 18-23). 5 µl phage containing solution (bacterial lysate) at concentration $1 \cdot 10^7 - 1 \cdot 10^9$ phages per ml of Ep007 tested with 195 µl of each Pst bacterium at $OD_{600} = 0.3$. The bacteria used was as follows: Pst1-14, 16 and 18-23 (DC). 10 µl of the phage solution was tested with 190 µl of each Pst bacteria at $OD_{600} = 0.3$ in its logarithmic growth stage. Host range was defined by bacterial susceptibility or resistance to tested bacteriophages. Bacteriophage Ep007 from group F inhibited almost all Pst strains growth (except Pst 2, 6, 7, 11, 18 and 19).

The present invention, in some embodiments thereof, relates to agricultural compositions comprising bacteriophages for the control of plant pathogens.

Before explaining at least one embodiment of the invention in detail, it is to be understood that the invention is not necessarily limited in its application to the details set forth in the following description or exemplified by the examples. The invention is capable of other embodiments or of being practiced or carried out in various ways.

The present inventors have uncovered novel bacteriophages that are capable of infecting, replicating within and lysing *Pseudomonas syringae* pv. tomato. The present inventors propose that such bacteriophages are useful in controlling bacterial speck disease in tomato plants.

Whilst reducing the present invention to practice, the present inventors have now uncovered that particular combinations of these novel phages are synergistic in their ability to lyse the bacteria and therefore bring about an enhanced ability to control bacterial speck in plants.

Thus, according to a first aspect of the present invention, a method of controlling or preventing bacterial speck disease is provided by contacting the plant with an effective amount of at least one bacteriophage capable of infecting the plant pathogen *Pseudomonas syringae* pv. tomato, the at least one bacteriophage having a genomic nucleic acid sequence at least 85% identical to the nucleic acid sequence as set forth in SEQ ID NOs: 1, 2, 3, 4, 5, 6, 78, 9, 10, 11, 12, 13, 14, 15, 16, 17, 18, 19, 20, 21, 22 or 23, thereby controlling or preventing the bacterial speck disease of the plant.

The term "plant" as used herein encompasses whole plants, a grafted plant, ancestors and progeny of the plants and plant parts, including seeds, shoots, stems, roots, rootstock, scion, foliage and plant cells, tissues and organs. The plant may be in any form including suspension cultures, embryos, meristematic regions, callus tissue, leaves, gametophytes, sporophytes, pollen, and microspores.

The tomato plant can be of a cultivated genetic background or a wild tomato genetic background.

As used herein, the term "tomato" refers to a plant, line or population within the species *Solanum lycopersicum* (synonyms are *Lycopersicon lycopersicum* or *Lycopersicon esculentum*) or formerly known under the genus name of *Lycopersicon* including but not limited to *L. cerasiforrne, L. cheesmanii, L. chilense, L. chmielewskii, L. esculentum* (now *S. pennellii*), *L. hirsutum, L. parviborum, L. pennellii, L. peruvianum, L. pimpinellifolium*, or *S. lycopersicoides*. The newly proposed scientific name for *L. esculentum* is *S. pennellii*. Similarly, the names of the wild species may be altered. *L. pennellii* has become *S. pennellii, L. hirsutum* may become *S. habrochaites, L. peruvianum* may be split into S. 'N peruvianum' and S. 'Callejon de Hueyles', *S. peruvianum*, and *S. corneliomuelleri, L. parviflorum* may become *S. neorickii, L. chmielewskii* may become *S. chmielewskii, L. chilense* may become *S. chilense, L. cheesmaniae* may become *S. cheesmaniae* or *S. galapagense*, and *L. pimpinellifolium* may become *S. pimpinellifolium*.

Generally, a cultivated tomato refers to tomato which is suitable for consumption and meets the requirements for commercial cultivation, e.g. typically classified as *Solanum lycopersicum*. In addition to the tomato plants themselves, and the parts thereof suitable for consumption, such as the fruit, the invention comprises parts or derivatives of the plant suitable for propagation. Examples of parts suitable for propagation are organ tissues, such as leaves, stems, roots, shoots and the like, protoplasts, somatic embryos, anthers, petioles, cells in culture and the like. Derivatives suitable for propagation are for instance seeds. The plants according to the invention can be cultivated or propagated in the conventional manner but also by means of tissue culture techniques from plant parts.

The choice of a variety depends on market demand, regional adaptability, disease resistance and the end use of the product. Exemplary segments for fresh market tomatoes include, but are not limited to, Beef (fruit weight of about 220-400 gr), Standard (fruit weight of about 160-220 gr) and Cluster (uniform fruit weight of about 120-180 gr). Such varieties are available from major seed companies e.g., Grodena, Macarena, Estatio, Zouk, Climbo and Climstar, all available from Syngenta. Other varieties can be proprietary or available from other vendors, including but not limited to, Cherry-micro (up to 5 gr) round cherry, mini round cherry (7.5-15 gr), mini plum elongated cherry (10-25 gr). Examples for these varieties are: Creativo (Clause), Batico (Nirit seeds), Shiren (Hazera Genetics). Cocktail round and elongated (25-40 gr): Romanita, Cherry and Cocktail with red, yellow, orange, pink, zebra, chocolate background. Examples include, but are not limited to, Summer sun (Hazera Genetics), Black pearl (Burpee) Tyty (Tomodori). Roma determinate and indeterminate. 120-200 gr. Examples for the intermediate marker include, but are not limited to, lancelot (Vilomorin) and Parsifal (Vilomorin). Pink tomato divided to beef (220-400), standard (160-220) and cluster (120-180). Example: Momotaro type, Cor di bue tomato, (150-350 gr), Pinton (250-300 gr), open field tomato-determinate or semi-determinate (180-400 gr).

Exemplary cultivars of processing tomatoes include, but are not limited to, Roma, SUN 6366, AB 2, Heinz 9780, Heinz 9557, Halley 3155 and Hypeel 303.

There are two major types of tomato growth: determinate and indeterminate. Determinate growth produces "bush" tomatoes and which are bred for compactness. The entire plant stops growing once the terminal fruit ripens, the remainder of the fruit all ripen nearly simultaneously, and then the plant dies. Indeterminate growth produces tomatoes that can grow up to 10 feet in height (so-called "vining"

tomatoes) and will only stop growing when killed (e.g. by frost). Their fruits ripen sequentially. In a typical plant, all growth arises from the reiteration of modular sympodial units that each produce three leaves and a multiflowered inflorescence. Most field-grown varieties of tomato, including M82, are determinate plants whose shoots produce an average of six sympodial units, each harboring a single inflorescence, within which leaf number gradually decreases before a precocious termination of growth. In general, determinate tomatoes are suitable for open field production. Semi-determinate and indeterminate "cultivated" varieties are suitable for staked cultivation in the open field or protected nets and for glasshouse cultivation.

According to an embodiment of the invention the tomato plant is a determinate tomato.

According to an embodiment of the invention the tomato plant is an indeterminate tomato.

According to an embodiment of the invention the tomato plant is a semi-determinate tomato.

According to an embodiment, the tomato is selected from the group consisting of a single fruit per truss, branched tomato and cherry tomato.

As used herein, the term "bacteriophage" and "phage" are used interchangeably and refer to an isolated virus that is capable of infecting a bacterium. Typically, a bacteriophage will be characterized by: 1) the nature of the nucleic acids that make up its genome, e.g., DNA, RNA, single-stranded or double-stranded and/or the genomic sequence thereof; 2) the nature of its infectivity, e.g., lytic or temperate; 3) the receptor on the bacterium to which the bacteriophage is attached during the infection; and 4) the particular bacterial subspecies that it infects (and in certain instances the particular strain of that subspecies). This aspect is known as "host range".

As used herein, the phrases "isolated bacteriophage", "isolate" or grammatical equivalents refer to a bacteriophage which is removed from its natural environment (e.g. removed from bacteria which it typically infects or soil, water and other material in which it dwells). In one embodiment, the isolated bacteriophage is removed from cellular material and/or other elements that naturally exist in the source clinical or environmental sample. The term isolated bacteriophages includes such bacteriophages isolated from the environment ("environmental isolates").

In one embodiment, the bacteriophages are lytic.

The term "lytic bacteriophage" refers to a bacteriophage that infects a bacterial host and causes that host to lyse without incorporating the bacteriophage nucleic acids into the host genome. A lytic bacteriophage is typically not capable of reproducing using the lysogenic cycle.

In another embodiment, the bacteriophages are lysogenic.

The term "lysogenic bacteriophage" refers to a bacteriophage that is capable of reproducing using the lysogenic cycle.

As used herein, the phrase "bacteriophage strain" refers to the sequenced phage, as described herein.

The term "*Pseudomonas syringae* pv. tomato" relates to the gram-negative bacterial pathogen which is the causal agent of bacterial speck of tomato. According to some classifications, it belongs to the species *P. syringae* genospecies III.

Exemplary strains of *Pseudomonas syringae* pv. tomato that are infected by the bacteriophage strains of the present invention are those that are found in environmental specimens (e.g. soil, water and other material).

In a particular embodiment, the bacteriophages described herein are capable of infecting at least one, two, three, four, five, six, seven, eight, nine or more *Pseudomonas syringae* pv. tomato strains that are causative for bacterial speck disease.

Also contemplated are progeny of the bacteriophages that have a genomic nucleic acid as set forth in SEQ ID NOs: 1-23, wherein the progeny is capable of infecting the same subspecies (or even strain) of bacteria as that which the parent bacteriophage having one of the above set forth genomic nucleic acid sequence infects. Such progeny may have genomes having a sequence at least 85% identical, at least 90% identical, at least 91% identical, at least 92% identical, at least 93% identical, at least 94% identical, at least 95% identical, 96% identical, 97% identical 98% identical, or 99% identical to the genome of the parent bacteriophage.

As used herein, the term "or progeny of the bacteriophage" refers to bacteriophages stemming from or derived from the strains identified herein.

Also contemplated are functional homologs of those that have a genomic nucleic acid sequence as set forth in SEQ ID NOs: 1-23 (in particular SEQ ID NOs: 1 1-11, 13-15, 18-20 and 22-23), wherein the functionally homologous bacteriophage is capable of infecting essentially bacteria of the same subspecies (or strain) as that which the bacteriophage having one of the above set forth genomic nucleic acid sequence infects. Typically, the homologs have a genomic nucleic acid sequence at least 85%, 86%, 87%, 88%, 89%, 80%, 91%, 92%, 93%, 94%, 95%, 96%, 97%, 98% 99% identical to the nucleic acid sequences as set forth in SEQ ID NOS: 1-23.

As used herein "functional homolog" or "functionally homologous" or "variant" or grammatical equivalents as used herein refer to a bacteriophage with a genomic nucleic acid sequence different than that of the sequenced bacteriophage (e.g., at least one mutation) resulting in a bacteriophage that is endowed with substantially the same ensemble of biological activities (+/−10%, 20%, 40%, 50%, 60% when tested under the same conditions) as that of the sequenced bacteriophage and can be classified as infecting essentially the same strain or subspecies of bacteria based on known methods of species/strain classifications.

A bacteriophage "infects" bacteria if it is capable of incorporating its nucleic acid into the bacterial cell.

In one embodiment, the viral nucleic acid integrates into the bacterial genome (i.e. lysogenic pathway).

According to a particular embodiment, the bacteriophage disclosed herein lyse their target bacteria.

According to some embodiments, the genomic nucleic acid sequence of the bacteriophages described herein is at least about 85%, at least about 90%, at least about 91%, at least about 92%, at least about 93%, at least about 94%, at least about 95%, at least about 96% least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, or more identical to the genomic sequence of the genomic sequences as set forth in SEQ ID NOs: 1, 2, 3, 4, 5, 6, 7, 8, 9, 10, 11, 12, 13, 14, 15, 16, 17, 18, 19, 20, 21, 22 or 23.

In particular, the bacteriophage has a genomic nucleic acid sequence at least 95% identical (% homologous) to the nucleic acid sequence as set forth in SEQ ID NOs: 1, 2, 3, 4, 5, 6, 7, 8, 9, 10, 11, 12, 13, 14, 15, 16, 17, 18, 19, 20, 21, 22 or 23.

According to a specific embodiment, the bacteriophage has a genomic nucleic acid sequence at least 95% identical (% homologous) to the full length nucleic acid sequence as set forth in SEQ ID NOs: 1, 2, 3, 4, 5, 6, 7, 8, 9, 10, 11, 12, 13, 14, 15, 16, 17, 18, 19, 20, 21, 22, or 23.

As used herein, "percent homology", "percent identity", "sequence identity" or "identity" or grammatical equivalents as used herein in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89 (22): 10915-9].

Percent identity can be determined using any homology comparison software, including for example, the BLASTN software of the National Center of Biotechnology Information (NCBI) such as by using default parameters.

Other exemplary sequence alignment programs that may be used to determine % homology or identity between two sequences include, but are not limited to, the FASTA package (including rigorous (SSEARCH, LALIGN, GGSEARCH and GLSEARCH) and heuristic (FASTA, FASTX/Y, TFASTX/Y and FASTS/M/F) algorithms, the EMBOSS package (Needle, stretcher, water and matcher), the BLAST programs (including, but not limited to BLASTN, BLASTX, TBLASTX, BLASTP, TBLASTN), megablast, DIAMOND and BLAT. In some embodiments, the sequence alignment program is BLASTN. For example, 95% homology refers to 95% sequence identity determined by BLASTN, by combining all non-overlapping alignment segments (BLAST HSPs), summing their numbers of identical matches and dividing this sum with the length of the shorter sequence.

In some embodiments, the sequence alignment program is a basic local alignment program, e.g., BLAST. In some embodiments, the sequence alignment program is a pairwise global alignment program. In some embodiments, the pairwise global alignment program is used for protein-protein alignments. In some embodiments, the pairwise global alignment program is Needle. In some embodiments, the sequence alignment program is a multiple alignment program. In some embodiments, the multiple alignment program is MAFFT. In some embodiments, the sequence alignment program is a whole genome alignment program. In some embodiments, the whole genome alignment is performed using BLASTN. In some embodiments, BLASTN is utilized without any changes to the default parameters.

According to some embodiments of the invention, the identity is a global identity, i.e., an identity over the entire nucleic acid sequences of the invention and not over portions thereof.

According to an additional or alternative embodiment, a functional homolog is determined as the average nucleotide identity (ANI), which detects the DNA conservation of the core genome (Konstantinidis K and Tiedje J M, 2005, Proc. Natl. Acad. Sci. USA 102:2567-2592). In some embodiments, the ANI between the functional homolog and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23 is of at least about 95%, at least about, 96%, at least about 97%, at least about 98%, at least about 99%, at least about 99.1%, at least about 99.5%, at least about 99.6%, at least about 99.7%, at least about 99.8%, at least about 99.9% or more.

According to an additional or alternative embodiment, a functional homolog is determined by the degree of relatedness between the functional homolog and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23 determined as the Tetranucleotide Signature Frequency Correlation Coefficient, which is based on oligonucleotide frequencies (Bohlin J. et al. 2008, BMC Genomics, 9:104). In some embodiments, the Tetranucleotide Signature Frequency Correlation coefficient between the variant and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22, 23 or 24 is of about 0.99, 0.999 or more.

According to an additional or alternative embodiment, the degree of relatedness between the functional homolog and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23 is determined as the degree of similarity obtained when analyzing the genomes of the parent and of the variant bacteriophage by Pulsed-field gel electrophoresis (PFGE) using one or more restriction endonucleases. The degree of similarity obtained by PFGE can be measured by the Dice similarity coefficient. In some embodiments, the Dice similarity coefficient between the variant and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23 is of at least about 96%, at least about 97%, at least about 98%, at least about 99%, at least about 99.1%, at least about 99.5%, at least about 99.6%, at least about 99.7%, at least about 99.8%, at least about 99.9% or more.

According to an additional or alternative embodiment, the degree of relatedness between the functional homolog and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23 is determined by the Pearson correlation coefficient obtained by comparing the genetic profiles of both phages obtained by repetitive extragenic palindromic element-based PCR (REP-PCR) (sec e.g. Chou and Wang, Int J Food Microbiol. 2006, 110:135-48). In some embodiments, the Pearson correlation coefficient obtained by comparing the REP-PCR profiles of the variant and the sequenced bacteriophage is of at least about 0.99, at least about 0.999 or more-see for example bmcmicrobioldotbiomedcentraldotcom/articles/10.1186/s12866-020-01770-2 (Damnjanovic et al, BMC Microbiol 20, 154 (2020)).

According to an additional or alternative embodiment, the degree of relatedness between the functional homolog and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23 is defined by the linkage distance obtained by comparing the genetic profiles of both phages obtained by Multi-locus sequence typing (MLST) (see e.g. Maiden, M. C., 1998, Proc. Natl. Acad. Sci. USA 95:3140-3145). In some embodiments, the linkage distance obtained by MLST of the functional homolog and the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23 is of at least about 0.99, at least about 0.999 or more.

According to an additional or alternative embodiment, the functional homolog comprises a functionally conserved gene or a fragment thereof e.g., an integrase gene, a polymerase gene, a capsid protein assembly gene, a DNA terminase, a tail fiber gene, or a repressor gene that is at least about 97%, at least about 98%, at least about 99%, at least about 99.1%, at least about 99.5%, at least about 99.6%, at least about 99.7%, at least about 99.8%, at least about 99.9%, or more identical to that of the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23.

According to an additional or alternative embodiment, the functional homolog is defined by a comparison of the coding sequence (gene) order.

According to an additional or alternative embodiment, the functional homolog is defined by a comparison of order of non-coding sequences.

According to an additional or alternative embodiment, the functional homolog is defined by a comparison of order of coding and non-coding sequences.

According to some embodiments of the invention, the combined coding region of the functional homolog is such that it maintains the original order of the coding regions as within the genomic sequence of the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23, yet without the non-coding regions.

For example, in case the genomic sequence has the following coding regions, A, B, C, D, E, F, G, each flanked by non-coding sequences (e.g., regulatory elements, and the like), the combined coding region will include a single nucleic acid sequence having the A+B+C+D+E+F+G coding regions combined together while maintaining the original order of their genome, yet without the non-coding sequences.

According to some embodiments of the invention, the combined non-coding region of the functional homolog is such that it maintains the original order of the non-coding regions as within the genomic sequence of the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23, yet without the coding regions as originally present in the original bacteriophage.

According to some embodiments of the invention, the combined non-coding region and coding region (i.e., the genome) of the functional homolog is such that it maintains the original order of the coding and non-coding regions as within the genomic sequence of the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23.

As used herein "maintains" relate to at least about 90%, 91%, 92%, 93%, 94%, 95%, 96%, 97%, 98%, 99% or 100% of the coding and/or non-coding regions of the functional homolog compared to the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23.

According to an additional or alternative embodiment, the functional homolog is defined by a comparison of gene content.

According to a specific embodiment, the functional homolog comprises a combined coding region at least about 90%, at least about 91%, at least about 92%, at least about 93%, at least about 94%, at least about 95%, at least about 96%, at least about 97%, at least about 98%, at least about 99%, or more (e.g., 100%) identical to the combined coding region existing in genome of the bacteriophage having a genome as set forth in any one of SEQ ID NO: 1, 2, 3, 4, 5, 6, 7, 8, 9, 10, 11, 12, 13, 14, 15, 16, 17, 18, 19, 20, 21, 22 or 23.

As used herein "combined coding region" refers to a nucleic acid sequence including all of the coding regions of the original bacteriophage yet without the non-coding regions of the original bacteriophage.

In one embodiment, the bacteriophages show up to 85%, 86%, 87%, 88%, 89%, 90%, 91%, 92%, 93%, 94%, 95%, 96%, 97%, 98%, 99% sequence identity with the bacteriophages disclosed herein and share at least one of the following characteristics-similar host range; similar type of infectivity (i.e., lytic or temperate).

In another embodiment, the bacteriophages show up to 85%, 86%, 87%, 88%, 89%, 90%, 91%, 92%, 93%, 94%, 95%, 96%, 97%, 98%, 99% sequence identity with the bacteriophages disclosed herein and share both of the following characteristics-similar host range, similar type of infectivity.

Additional bioinformatics methods that may be used to determine relatedness between two bacteriophage genomes include Nucmer and Minimap, both of which are alignment based tools; Jacard distance and MinHash, each of which are information based tools; and Codon usage similarity, pathway similarity and protein motif similarity.

As used herein, "host range" refers to the bacteria that are susceptible to infection by a particular phage. The host range of a bacteriophage may include, but is not limited to, a strain, a subspecies, a species, a genus, or multiple genera of bacteria.

Bacteriophage isolates may be prepared and phenotyped using methods known in the art, e.g., a plaque assay, liquid media assay, solid media assay. In some embodiments, the solid media assays to quantify and isolate bacteriophage are based on plaque assays (S. T. Abedon et al., Methods in Molecular Biology 2009 (Clifton, N.J.), 501, 161-74), ranging from efficiency of plating (EOP) (E. Kutter, Methods in Molecular Biology 2009 (Clifton, N.J.), 501, 141-9) to spot testing (P. Hyman et al., Advances in Applied Microbiology (1st ed., Vol. 70, pp. 217-48) 2010. Elsevier Inc.). In some embodiments, the plate format used for the plaque assay can be modified, e.g., from a petri dish to a 48-well plate.

In some embodiments, infectivity is determined by the plaque presence in a solid assay only. In some embodiments, infectivity is determined by the plaque presence in a liquid assay only. In some embodiments, infectivity is determined by the plaque presence in both the liquid assay and the solid assay.

The bacteriophages described herein are typically present in a preparation in which their prevalence (i.e., concentration) is enriched over that (exceeds that) found in nature.

Since bacteriophages infect bacterial cells, they may be found in specimens or samples which are rich in bacteria—e.g. environmental samples such as soil, water and other material. According to some embodiments of the invention, the agricultural composition (i.e. preparation) comprises less than 50 microbial species, e.g., bacteria and/or fungi—e.g. less than 40 bacterial species, less than 30 bacterial species, less than 20 bacterial species, less than 10 bacterial species, less than 5 bacterial species, less than 4 bacterial species, less than 3 bacterial species, less than 2 bacterial species or even devoid completely of bacteria.

According to a particular embodiment, the agricultural composition comprises a single strain of bacteriophage (or a functional homolog thereof), no more than two different bacteriophage strains (or functional homologs thereof), no more than three different bacteriophage strains (or functional homologs thereof), no more than four different bacteriophage strains (or functional homologs thereof), no more than five different bacteriophage strains (or functional homologs thereof), no more than six different bacteriophage strains (or functional homologs thereof), no more than seven different bacteriophage strains (or functional homologs thereof), no more than eight different bacteriophage strains (or functional homologs thereof), no more than nine different bacteriophage strains (or functional homologs thereof), or no more than ten different bacteriophage strains (or functional homologs thereof).

In a particular embodiment, the agricultural composition comprises no additional bacteriophage that infect plant pathogens other than *Pseudomonas syringae* pv. tomato.

In a particular embodiment, the preparation comprises no additional bacteriophage that infects non-plant pathogens (e.g. bacteria that cause disease in humans).

The present inventors contemplate agricultural compositions comprising bacteriophages that are directed only to *Pseudomonas syringae* pv. tomato.

Particular combinations of bacteriophages that are directed to *Pseudomonas syringae* pv. tomato that are contemplated include:

1. SEQ ID NO: 7 and SEQ ID NO: 9;
2. SEQ ID NO: 7 and SEQ ID NO: 17;
3. SEQ ID NO: 7 and SEQ ID NO: 18;
4. SEQ ID NO: 7 and SEQ ID NO: 19;
5. SEQ ID NO: 7 and SEQ ID NO: 12;
6. SEQ ID NO: 12 and SEQ ID NO: 9;
7. SEQ ID NO: 7, SEQ ID NO: 9 and SEQ ID NO: 12;
8. SEQ ID NO: 17 and SEQ ID NO: 18;
9. SEQ ID NO: 17 and SEQ ID NO: 19;
10. SEQ ID NO: 7, SEQ ID NO: 9 and SEQ ID NO: 18;
11. SEQ ID NO: 7, SEQ ID NO: 9 and SEQ ID NO: 19;
12. SEQ ID NO: 17, SEQ ID NO: 18 and SEQ ID NO: 19;
13. SEQ ID NO: 7, SEQ ID NO: 17, SEQ ID NO: 18 and SEQ ID NO: 19.
14. SEQ ID NO: 7, SEQ ID NO: 17 and SEQ ID NO: 21.
15. SEQ ID NO: 17, SEQ ID NO: 19 and SEQ ID NO: 20.

The bacteriophage compositions can be applied to plants by spraying, fogging, dusting, coating, soaking, irrigation, drenching or otherwise treating them with the active ingredients or alternatively, by treating the plant seeds, the soil around the plant, or the soil, rice pads or the water for hydroponic culture where the seeds are to be sown with the bacteriophages. The application may be affected either before (preventatively) or after the plant is infected with the pathogen.

According to an embodiment, the regimen is performed such as to control the spread of the pathogen and/or eliminate the pathogen and/or eliminate/reduce/minimize any damage that can be caused by the pathogen.

The bacteriophages can be formulated as dips, sprays, seed coatings or concentrates.

In one embodiment, the bacteriophages are provided as a dried formulation—e.g. powder.

It will be appreciated that by controlling (i.e. reducing) pathogenic infection in the plant, the post-harvest quality of the plant is improved and losses are reduced. Concurrently, or alternatively, plant performance parameters may also be improved (including, but not limited to growth parameters, crop production, and pathogenic resistance).

The contacting may be effected at any stage of the plant life cycle e.g. a post-blossom stage, a blossom stage, a pre-blossom stage, or any combination thereof.

In one embodiment, the contacting is effected at the seedling stage (e.g. 4 leaf stage)

The contacting may be effected in the vicinity of or onto: a root, a stem, a trunk, a seed, a fruit, a flower, a leaf, or any combination thereof of the plant.

According to an embodiment, applying is in an open field. According to an embodiment, applying is in a greenhouse or a nursery. According to an embodiment, applying is applying once. According to an embodiment, applying is applying at least twice at any regimen or duration.

According to an embodiment, the applying comprises repeated application (2 or more applications e.g., every day, every week, seasonal, bi-weekly, bi-monthly etc.). Repeated applications are especially envisaged for field/greenhouse treatments.

According to an embodiment, repeated application comprises daily, weekly, daily, monthly, or bi-monthly administration during blossom, post-blossom, pre-blossom, or any combination thereof. For example, suggested regimen may include but is not limited to, spraying plants in open fields and green house, adding to irrigation of plants grown in the open field, green house, nursery and in pots.

It has been demonstrated that applying phage to tomato leaves in the evening resulted in longer phage persistence in the phyllosphere, giving phage more time to infect and kill their bacterial targets (Balogh et al., Plant Dis. 87, 949-954. doi: 10.1094/PDIS.2003.87. 8.949, 2003; Iriarte et al., Appl. Environ. Microbiol. 73, 1704-1711. doi: 10.1128/AEM.02118-06, 2007).

Accordingly, in one embodiment, the contacting is not carried out during daylight hours In one embodiment, the contacting is effected in the absence of a copper based product.

The bacteriophages disclosed herein may be provided per se, or may be formulated with an agriculturally acceptable carrier.

As used herein the term "agriculturally acceptable carrier" refers to a material that facilitates application of the bacteriophage to the intended target, which may be for example a plant, a plant material, compost, earth, surroundings or equipment, or that facilitates storage, transport or handling. Carriers used in compositions for application to plants and plant material are preferably non-phytotoxic or only mildly phytotoxic. A suitable carrier may be a solid, liquid or gas depending on the desired formulation. In one embodiment the carriers include polar liquid carriers such as water, mineral oils and vegetable oils. In one embodiment the carrier enhances the stability of the active ingredient as described herein.

The carrier can include a dispersant, a surfactant, an additive, water, a thickener, an anti-caking agent, residue breakdown, a composting formulation, a granular application, diatomaceous earth, an oil, a coloring agent, a stabilizer, a preservative, a polymer, a coating, or a combination thereof. One of ordinary skill in the art can readily determine the appropriate carrier to be used taking into consideration factors such as a particular bacteriophage strain, plant to which the bacteriophage is to be applied, type of soil, climate conditions, whether the bacteriophage is in liquid, solid or powder form, and the like.

The additive can comprise an oil, a gum, a resin, a clay, a poly ethylene glycol, a terpene, a viscid organic, a fatty acid ester, a sulfated alcohol, an alkyl sulfonate, a petroleum sulfonate, an alcohol sulfate, a sodium alkyl butane diamate, a polyester of sodium thiobutant dioate, a benzene acetonitrile derivative, a proteinaceous material, or a combination thereof.

The surfactant can contain a heavy petroleum oil, a heavy petroleum distillate, a polyol fatty acid ester, a polyethoxylated fatty acid ester, an aryl alkyl poly ethylene glycol, an alkyl amine acetate, an alkyl aryl sulfonate, a polyhydric alcohol, an alkyl phosphate, or a combination thereof.

The anti-caking agent can include a sodium salt such as a sodium sulfite, a sodium sulfate, a sodium salt of monomethyl naphthalene sulfonate, a sodium salt of dimethyl naphthalene sulfonate, or a combination thereof; or a calcium salt such as calcium carbonate, diatomaceous earth, or a combination thereof.

In one embodiment, the composition is devoid of copper based element.

Exemplary agriculturally acceptable carriers include, but are not limited to, vermiculite, charcoal, sugar factory carbonation press mud, rice husk, carboxymethyl cellulose, peat, perlite, fine sand, calcium carbonate, flour, alum, a starch, talc, polyvinyl pyrrolidone, or a combination thereof.

The bacteriophage cultures can be prepared as solid, liquid. emulsion or powdered formulations as is known in the art. The cultures of the present invention can be formulated as a seed coating formulation, a liquid formulation for application to plants or to a plant growth medium, or a solid formulation for application to plants or to a plant growth medium.

When the bacteriophage culture is prepared as a liquid formulation for application to plants or to a plant growth medium, it can be prepared in a concentrated formulation or a working form formulation. In some instances, the seed coating formulation of the present invention is an aqueous or oil-based solution for application to seeds.

When the bacteriophage culture of the present invention is prepared as a solid formulation for application to plants or to a plant growth medium, it can be prepared as a granular formulation or a powder agent. The seed coating formulation can be a powder or granular formulation for application to seeds.

The bacteriophage culture can further include an agrochemical (i.e. an agent that promotes the growth of a plant and/or maintains the health of a plant).

Examples of such agents include a fertilizer, a micronutrient fertilizer material, an insecticide, a herbicide, a plant growth regulator, an acaricide, a rodenticide, a fungicide, a nutrient, a molluscicide, an algicide, a pesticide, a fungal inoculant, or a combination thereof.

In some instances, the fertilizer is a liquid fertilizer. The agrochemical can either be applied to a plant growth medium or to plants and/or seeds. Liquid fertilizer can include, without limitation, ammonium sulfate, ammonium nitrate, ammonium sulfate nitrate, ammonium chloride, ammonium bisulfate, ammonium polysulfide, ammonium thiosulfate, aqueous ammonia, anhydrous ammonia, ammonium polyphosphate, aluminum sulfate, calcium nitrate, calcium ammonium nitrate, calcium sulfate, calcined magnesite, calcitic limestone, calcium oxide, calcium nitrate, dolomitic limestone, hydrated lime, calcium carbonate, diammonium phosphate, monoammonium phosphate, magnesium nitrate, magnesium sulfate, potassium nitrate, potassium chloride, potassium magnesium sulfate, potassium sulfate, sodium nitrates, magnesian limestone, magnesia, urea, urea-formaldehydes, urea ammonium nitrate, sulfur-coated urea, polymer-coated urea, isobutylidene diurea, $K_2SO_4$-$2MgSO_4$, kainite, sylvinite, kieserite, Epsom salts, elemental sulfur, marl, ground oyster shells, fish meal, oil cakes, fish manure, blood meal, rock phosphate, super phosphates, slag, bone meal, wood ash, manure, bat guano, peat moss, compost, green sand, cottonseed meal, feather meal, crab meal, fish emulsion, or a combination thereof.

The micronutrient fertilizer material can comprise boric acid, a borate, a boron frit, copper sulfate, a copper frit, a copper chelate, a sodium tetraborate decahydrate, an iron sulfate, an iron oxide, iron ammonium sulfate, an iron frit, an iron chelate, a manganese sulfate, a manganese oxide, a manganese chelate, a manganese chloride, a manganese frit, a sodium molybdate, molybdic acid, a zinc sulfate, a zinc oxide, a zinc carbonate, a zinc frit, zinc phosphate, a zinc chelate, or a combination thereof.

The insecticide can include an organophosphate, a carbamate, a pyrethroid, an acaricide, an alkyl phthalate, boric acid, a borate, a fluoride, sulfur, a haloaromatic substituted urea, a hydrocarbon ester, a biologically-based insecticide, or a combination thereof.

The herbicide can comprise a chlorophenoxy compound, a nitrophenolic compound, a nitrocresolic compound, a dipyridyl compound, an acetamide, an aliphatic acid, an anilide, a benzamide, a benzoic acid, a benzoic acid derivative, anisic acid, an anisic acid derivative, a benzonitrile, benzothiadiazinone dioxide, a thiocarbamate, a carbamate, a carbanilate, chloropyridinyl, a cyclohexenone derivative, a dinitroaminobenzene derivative, a fluorodinitrotoluidine compound, isoxazolidinone, nicotinic acid, isopropylamine, an isopropylamine derivative, oxadiazolinone, a phosphate, a phthalate, a picolinic acid compound, a triazine, a triazole, a uracil, a urea derivative, endothall, sodium chlorate, or a combination thereof.

The fungicide can comprise a substituted benzene, a thiocarbamate, an ethylene bis dithiocarbamate, a thiophthalidamide, a copper compound, an organomercury compound, an organotin compound, a cadmium compound, anilazine, benomyl, cyclohexamide, dodine, etridiazole, iprodione, metlaxyl, thiamimefon, triforine, or a combination thereof.

The fungal inoculant can comprise a fungal inoculant of the family Glomeraceae, a fungal inoculant of the family Claroidoglomeraceae, a fungal inoculant of the family Gigasporaceae, a fungal inoculant of the family Acaulosporaceae, a fungal inoculant of the family Sacculosporaceae, a fungal inoculant of the family Entrophosporaceae, a fungal inoculant of the family Pacidsporaceae, a fungal inoculant of the family Diversisporaceae, a fungal inoculant of the family Paraglomeraceae, a fungal inoculant of the family Archacosporaceae, a fungal inoculant of the family Geosiphonaceae, a fungal inoculant of the family Ambisporaceae, a fungal inoculant of the family Scutellosporaceae, a fungal inoculant of the family Dentiscultataceae, a fungal inoculant of the family Racocetraceae, a fungal inoculant of the phylum Basidiomycota, a fungal inoculant of the phylum Ascomycota, a fungal inoculant of the phylum Zygomycota, or a combination thereof.

In one embodiment, the plant growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole-3-acetic acid, maleic hydrazide, mefluidide, mepiquat (mepiquat chloride), naphthaleneacetic c acid, N-6-benzyladenine, paclobutrazol, prohexadione (prohexadione-calcium), prohydrojasmon, thidiazuron, triapenthenol, tributyl phosphorotrithioate, 2,3,5-tri-iodobenzoic acid, trinexapac-ethyl and uniconazole. Other examples of plant growth regulators which can be comprised in the article of manufacture include those based on dichlorophene and benzylalcohol hemi formal (Proxel® from ICI or Acticide® RS from Thor Chemie and Kathon® MK from Rohm & Haas) and isothiazolinone derivatives such as alkylisothiazolinones and benzisothiazolinones (Acticide® MBS from Thor Chemie). Other plant growth regulators that can be incorporated seed coating compositions are described in US 2012/0108431, which is incorporated by reference in its entirety.

Preferred nematode-antagonistic biocontrol agents include ARF18; *Arthrobotrys* spp.; *Chactomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paccilomyces* spp.; *Pochonia* spp.; *Stagonospora* spp.; vesicular-arbuscular mycorrhizal fungi, *Burkholderia* spp.; *Pasteuria* spp., *Brevibacillus* spp.; *Pseudomonas* spp.; and *Rhizobacteria*. Particularly preferred nematode-antagonistic biocontrol agents include ARF18, *Arthrobotrys oligospora*, *Arthrobotrys dactyloides*, *Chactomium globosum*, *Cylindrocarpon heteronema*, *Exophilia jeanselmei*, *Exophilia pisciphila*, *Fusarium aspergilus*, *Fusarium solani*, *Gliocladium catenulatum*, *Gliocladium roseum*, *Gliocladium vixens*, *Hirsutella rhossiliensis*, *Hirsutella minnesotensis*, *Lecanicillium lecanii*, *Monacrosporium drechsleri*, *Monacrosporium gephyropagum*, *Myrotchcium verrucaria*, *Neocosmospora vasinfecta*, *Paccilomyces lilacinus*, *Pochonia chlamydosporia*, *Stagonospora heteroderac*, *Stagonospora phascoli*, vesicular-arbuscular mycorrhizal fungi, *Burkholderia cepacia*, *Pasteuria penetrans*, *Pasteuria thornei*, *Pasteuria nishizawae*, *Pasteuria ramosa*, *Pastrucia usage*, *Brevibacillus laterosporus* strain G4, *Pseudomonas fluorescens* and *Rhizobacteria*.

In another embodiment, the bacteriophage preparation can comprise a nutrient. The nutrient can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

In one embodiment, the preparation may comprise a rodenticide selected from the group of substances consisting of 2-isovalerylindan-1,3-dione, 4-(quinoxalin-2-ylamino) benzenesulfonamide, alpha-chlorohydrin, aluminum phosphide, antu, arsenous oxide, barium carbonate, bisthiosemi, brodifacoum, bromadiolone, bromethalin, calcium cyanide, chloralose, chlorophacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide As used herein the term "about" refers to ±10%

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Maryland (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells-A Manual of Basic Technique" by Freshney, Wiley-Liss, N.Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, CT (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, CA (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Phage Isolation from Environmental Sample

Materials And Methods

Isolation of bacteriophages from environmental samples: Soil samples were collected from open fields and greenhouses where tomato plants are grown or were grown recently. Samples were collected from 20-30 positions within the same location and pooled into 3-6 pools per location. Samples were typically derived from the root-associated soil, at shallow depth of up to 20 cm.

For bacteriophage isolation, 5-10 gr of pooled soil samples, were mixed with 25 ml of Nutrient Broth (NB) in the presence of 100 µg/ml cycloheximide and 100 µl of an overnight culture of the target bacterium. In each isolation experiment, one strain of the target bacteria was added to the mixture.

Mixtures containing soil samples, growth media, antibiotics and bacteria were shaken for 18-24 hours at 200 RPM, at 27° C. Then the mixtures were centrifuged for 10 minutes at 4,000 RCF, the supernatant was filtered through 2 layers of gauze and centrifuged again for 5 minutes at 4,000 RCF. The supernatant was then filtered through 0.45 µm filter and the sterile liquid (lysate with the phages) was collected in a fresh tube for further analysis.

Overlay plaque assay: An overnight culture of the same target bacterial strain that was used for bacteriophage isolation, was diluted to $OD_{600}=0.1$ and was grown for several hours until the $OD_{600}$ reached 0.3, suggesting early logarithmic (log) phase. 100 µl of the log phase bacteria were mixed with 100 µl of the bacteriophage lysate and left at room temperature for 5 minutes. Next, 4 ml of molten nutrient broth containing 0.5% agar and pre-heated to 55° C., was added to the bacteria/lysate mixture, mixed gently and quickly poured on top of a petri plate containing nutrient agar. The plates were incubated at 27° C. overnight. Plaques were visible as clear circles resulted from bacterial lysis.

Example 2

Phage DNA Extraction and Genome Sequencing

Materials and Methods

DNA extraction: Phages were enriched, each on specific bacterium according to their host range and filtered through a 0.22 µm mesh, this liquid is called a lysate. From each unique lysate, 500 µl were transferred to a clean 1.5 ml microcentrifuge tube and was added 1 µl of 10 mg/ml DNaseI (Sigma) and incubated at 37° C. for one hour. The DNA-free-lysate was further processed using the Qiagen DNA extraction kit Dneasy Blood & Tissue kit (20-69504) according to the product's guidelines for gram positive bacteria.

Sequencing library preparation: DNA sequencing was preformed using the Illumina platform. Library construction was performed using a protocol previously published by Baym et al.[1]. In short, the DNA extractions were quantified using the Qubit HS DNA quantification kit on a Quantus™ device (Promega). 1.5 ng of DNA (1.5 µg/µl) were distributed in one microliter of each sample and were subject to a "Tagmentation" process by mixing TD buffer (15027866) and TDE1 enzyme (15027865) with nucleic acids. This step was followed by the amplification of the tagged fragments, using Kapa Hifi enzyme and buffer alongside a set of sample specific primers called barcodes which enable post-processing of sequences according to source sample.

After the amplification step the libraries were cleaned and a size selection was performed using the AMPure XP magnetic beads (Beckman Coulter) according to the manufacturer's instruction. The samples were than assessed for average fragment size and quantity using the 4200 TapeStation system (Agilent). High quality samples were sequenced using Illumina system.

Sequence analysis: Quality for the short reads were checked using Fastp and assembled using Unicycler. The resulting assemblies were annotated using Prokka. Assemblies' nucleotides were used to build a Basic Local Alignment Search Tool (BLAST by NCBI) database and were searched against each other in a reciprocal manner. Further, assemblies which were of 95% similarity were clustered to groups and within group diversity was estimated by phylogenetic similarities. This was done by a phylogenetic tree, based on the genome of the analyzed data set. The alignment file of genomes was used to identify the single nucleotide polymorphisms (SNPs), using a multiple sequence alignment program (MAFFT). Phylogenetic reconstruction from genomes was conducted to compare the clustering of isolates against lineage generating approximately-maximum-likelihood phylogenetic tree (FastTree v2.1). Once classifying phylogroups, primer sets were designed to identify the isolates based on the sequence of the representing phage. All primers were tested for specificity within internal bacteriophage repository.

Homology analysis: Genomic sequences of all isolated phages were assembled using SPAde. The sequences were then compared to NCBI's non-redundant nucleotide collection using the BLASTN suite.

Results

The obtained sequences were assembled into genomes (Table 1). These bacteriophage genomes clustered to groups (uppercase letters) according to their genetic similarity, based on whole sequence identity. Several types (subgroups) within each group were also identified (in parentheses of Table 1, column 1).

Sequence analysis included annotation and illustration of main groups. All phages within a group have more than 95% similarity.

TABLE 1

| Phage grouping by sequence similarity | Phage name | SEQ ID | Bacterial host | Average genome size (bp) |
|---|---|---|---|---|
| F(1a) | Ep001 | 1 | Pst | 41379 |
| F(1b) | Ep002 | 2 | Pst | 41402 |
| F(2a) | Ep003 | 3 | Pst | 41361 |
| F(2b) | Ep004 | 4 | Pst | 40804 |
| F(2c) | Ep005 | 5 | Pst | 41367 |
| F(2d) | Ep006 | 6 | Pst | 41379 |
| F(2e) | Ep007 | 7 | Pst | 41364 |
| F(3) | Ep008 | 8 | Pst | 41331 |
| G | Ep009 | 9 | Pst | 41413 |
| G(1) | Ep010 | 10 | Pst | 39587 |
| G(2) | Ep011 | 11 | Pst | 39800 |
| H | Ep012 | 12 | Pst | 42526 |
| I(1) | Ep013 | 13 | Pst | 76208 |
| I(2) | Ep014 | 14 | Pst | 76086 |
| I(3) | Ep015 | 15 | Pst | 76141 |
| J | Ep016 | 16 | Pst | 43277 |
| KB1 | Ep017 | 17 | Pst | 40570 |
| KB16 | Ep019 | 18 | Pst | 40543 |
| AY2 | Ep020 | 19 | Pst | 98129 |
| SH1 | Ep021 | 20 | Pst | 42630 |
| SH2 | Ep022 | 21 | Pst | 40665 |
| SH5 | Ep023 | 22 | Pst | 40917 |
| SH8 | Ep024 | 23 | Pst | 39193 |

The primers were designed for each of the main groups for quality control purposes and are set forth in Table 2.

TABLE 2

| Target group | Product size | Forward | Reverse | Target gene/s |
|---|---|---|---|---|
| G (Ep009) | 330 | TGTACAGTTGAGGACC ACGC (SEQ ID NO: 25) | GGCGATGTCGTAATGG CAAC (SEQ ID NO: 26) | DNA packaging-> Holin |
| H (Ep012) | 187 | CGAACAGGCGATAGC AAAGC (SEQ ID NO: 27) | CCTTGCGTAAGCCGCA ATAC (SEQ ID NO: 28) | Non coding between tail proteins |
| F (Ep007) | 774 | ATTGGTCGCGGGGTTT ACTT (SEQ ID NO: 29) | CGCGCCAGAGTTCTCA TAGT (SEQ ID NO: 30) | DNA polymerase |
| AY2 (Ep020) | 344 | TGACGTTCGCATGGTT GAGA (SEQ ID NO: 31) | CGTTCCCGTTCTTGTC CTCA (SEQ ID NO: 32) | DNA polymerase |
| KB1 (Ep017) | 323 | TGCGTTGAACCAAGCA CAAG (SEQ ID NO: 33) | CAGAGGTCTGACTCGC AGTG (SEQ ID NO: 34) | Tail fiber protein |
| SH1 (Ep021) | 541 | CCAGGGTATTGTGCCA GGAG (SEQ ID NO: 35) | CGTGCAGGTTAGCTCT GTGA (SEQ ID NO: 36) | Putative phage tail tubular protein B |

TABLE 2-continued

| Target group | Product size | Forward | Reverse | Target gene/s |
|---|---|---|---|---|
| SH2 (Ep022) | 369 | ATGAACTGGCTCCAGA AGGC (SEQ ID NO: 37) | CGGTATGGTGCCGAAG CTAT (SEQ ID NO: 38) | Tail fiber protein |
| SH5 (Ep023) | 478 | ACAGCGATCCAAACG ACCAT (SEQ ID NO: 39) | TCTGAGCGTTCTCGCT TTGT (SEQ ID NO: 40) | Tail fiber protein |
| SH8 (Ep024) | 399 | ATCGGAACCTGAACAC TCGG (SEQ ID NO: 41) | CGAGGTAACCTTCAGG AGCC (SEQ ID NO: 24) | Tail fiber protein |

Single plaques were isolated by touching the plaque with a sterile tip, then resuspending in 1 ml NB and repeating the plaque overlay assay two more times as described above. At this point, plaques were considered to present a single bacteriophage and were propagated in 3 ml of NB in the presence of the target bacterium. Lysates were filter-sterilized and the bacteriophage titer was determined using a series of dilutions. DNA was extracted from the phages using the DNeasy Blood & Tissue Kit, Cat. No. 69504 (Qiagen, Germany), performing a DNAse I treatment step prior to the kit's protocol. The DNA was then sequenced using the Illumina Tagment DNA Enzyme and Buffer Kit (Illumina, USA).

For each of the phages, the highest percent identity and coverage is presented in Table 3, herein below.

TABLE 3

| Query phage | Reference (as described in the NCBI repository) | Percent identity | Alignment length | Coverage (% of query) | Mismatch | e value | Bitscore |
|---|---|---|---|---|---|---|---|
| Ep001 | gi\|966198107\|ref\|NC_028661.1\| *Pseudomonas* phage PPPL-1, complete genome | 77.208 | 5322 | 55 | 993 | 0 | 2905 |
| Ep002 | gi\|966198107\|ref\|NC_028661.1\| *Pseudomonas* phage PPPL-1, complete genome | 77.137 | 5323 | 54 | 995 | 0 | 2883 |
| Ep003 | gi\|966198107\|ref\|NC_028661.1\| *Pseudomonas* phage PPPL-1, complete genome | 77.404 | 5200 | 52 | 970 | 0 | 2904 |
| Ep004 | gi\|966198107\|ref\|NC_028661.1\| *Pseudomonas* phage PPPL-1, complete genome | 77.473 | 5207 | 53 | 954 | 0 | 2915 |
| Ep005 | gi\|966198107\|ref\|NC_028661.1\| *Pseudomonas* phage PPPL-1, complete genome | 79.591 | 3910 | 50 | 660 | 0 | 2673 |
| Ep006 | gi\|966198107\|ref\|NC_028661.1\| *Pseudomonas* phage PPPL-1, complete genome | 77.242 | 5330 | 55 | 977 | 0 | 2905 |
| Ep007 | gi\|966198107\|ref\|NC_028661.1\| *Pseudomonas* phage PPPL-1, complete genome | 77.488 | 5206 | 55 | 955 | 0 | 2920 |
| Ep008 | gi\|966198107\|ref\|NC_028661.1\| *Pseudomonas* phage PPPL-1, complete genome | 77.076 | 5322 | 51 | 1000 | 0 | 2867 |
| Ep009 | gi\|966198107\|ref\|NC_028661.1\| *Pseudomonas* phage PPPL-1, complete genome | 78.084 | 16308 | 78 | 3120 | 0 | 9897 |
| Ep010 | gi\|966198107\|ref\|NC_028661.1\| *Pseudomonas* phage PPPL-1, complete genome | 78.084 | 16308 | 79 | 3120 | 0 | 9897 |
| Ep011 | gi\|966198107\|ref\|NC_028661.1\| *Pseudomonas* phage PPPL-1, complete genome | 78.084 | 16308 | 78 | 3120 | 0 | 9897 |
| Ep012 | gi\|971766223\|ref\|NC_029019.1\| *Stenotrophomonas* phage vB_SmaS-DLP_2, complete genome | 97.844 | 22353 | 97 | 445 | 0 | 38573 |
| Ep013 | gi\|589889317\|ref\|NC_023556.1\| *Achromobacter* phage JWAlpha, complete genome | 76.181 | 995 | 2 | 217 | 4.41E−140 | 507 |
| Ep014 | gi\|589889317\|ref\|NC_023556.1\| *Achromobacter* phage JWAlpha, complete genome | 76.281 | 995 | 2 | 216 | 9.46E−142 | 512 |
| Ep015 | gi\|1211142923\|ref\|NC_031062.2\| *Erwinia* phage vB_EamP_Frozen, complete genome | 75.379 | 1320 | 2 | 290 | 1.52E−169 | 604 |
| Ep016 | gi\|971751647\|ref\|NC_028879.1\| *Pseudomonas* phage PaMx42, complete genome | 94.206 | 17120 | 96 | 868 | 0 | 26005 |
| Ep017 | gi\|29366701\|ref\|NC_004665.1\| *Pseudomonas* phage gh-1, complete genome | 97.681 | 22342 | 89 | 494 | 0 | 38367 |
| Ep019 | gi\|966198107\|ref\|NC_028661.1\| *Pseudomonas* phage PPPL-1, complete genome | 77.099 | 5323 | 53 | 997 | 0 | 2872 |
| Ep020 | gi\|589287214\|ref\|NC_023601.1\| *Pseudomonas* phage phiPsa374, complete genome | 83.271 | 10933 | 31 | 1670 | 0 | 9910 |
| Ep021 | gi\|281306659\|ref\|NC_013638.1\| *Pseudomonas* phage phi-2, complete genome | 74.703 | 1601 | 9 | 353 | 0 | 665 |
| Ep022 | gi\|658310745\|ref\|NC_024362.1\| *Pseudomonas* phage phiPSA2, complete genome | 98.391 | 28891 | 96 | 460 | 0 | 50771 |
| Ep023 | gi\|966198107\|ref\|NC_028661.1\| *Pseudomonas* phage PPPL-1, complete genome | 83.621 | 1044 | 15 | 158 | 0 | 968 |
| Ep024 | gi\|844383143\|ref\|NC_027292.1\| *Pseudomonas* phage Pf-10, complete genome | 78.174 | 6955 | 77 | 1317 | 0 | 4248 |

25

Example 3

Host Range Analysis of Phages Targeting *Pseudomonas* Strains

The *Pseudomonas* strains used in the host range analysis are summarized in Table 4, herein below.

TABLE 4

| Country of isolation | Commercial source | Stain | Vendors cat name/number |
|---|---|---|---|
| Denmark | NCPPB | Pst1 | 269 |
| Yugoslavia | NCPPB | Pst2 | 878 |
| Canada | NCPPB | Pst3 | 996 |
| USA | NCPPB | Pst4 | 1008 |
| UK | NCPPB | Pst5 | 1106 |
| Canada | NCPPB | Pst6 | 1368 |
| Switzerland | NCPPB | Pst7 | 2424 |
| New Zealand | NCPPB | Pst8 | 2683 |
| France | NCPPB | Pst9 | 3333 |
| Brazil | NCPPB | Pst10 | 3645 |
| Ukraine | NCPPB | Pst11 | 3784 |
| USA | NCPPB | Pst12 | 4369 |
| UK | ATCC | Pst13 | BAA-871 |
| USA | ATCC | Pst14 | 10862 |
| USA (Cornell University, NY) | NRRL (The Agriculture research service Culture Collection), USA | Pst16 | B-883 |
| JAPAN (IBARAKI) | NARO (National Agriculture and Food Research Organization), Japan | Pst18 | 302665 |
| JAPAN (TOCHIGI) | NARO (National Agriculture and Food Research Organization), Japan | Pst19 | 301591 |
| United States ([Unknown]) | The ICMP (International Collection of Microorganisms from Plants), NZ | Pst20 | ICMP 9324 |
| United Kingdom [Unknown] | The ICMP (International Collection of Microorganisms from Plants), NZ | Pst21 | ICMP 4933 |
| United States (San Diego, California) | The ICMP (International Collection of Microorganisms from Plants), NZ | Pst22 | ICMP 9499 |
| United States | The ICMP (International Collection of Microorganisms from Plants), NZ | Pst23 | ICMP 2843 |
| NSW, Australia | NSW Plant pathology & Mycology Herbarium | Pst24 | DAR 75965 |

26

Host range analysis of each of the isolated phages number 1-24 was performed against bacterial strains number Pst 1-15, 16 and 18-24. (Table 5). The assay was performed by adding a 10 µl drop of each bacteriophage lysate to a plate containing lawn of single bacterial strain. Plates with bacterial lawn and their respective phages were incubated overnight at 27° C. After incubation plaques become visible as a clearing of the bacterial lawn.

TABLE 5

| Phage\Bacteria | Pst 1 | Pst 2 | Pst 3 | Pst 4 | Pst 5 | Pst 6 | Pst 7 | Pst 8 | Pst 9 | Pst 10 | Pst 11 | Pst 12 | Pst 13 | Pst 14 | Pst 15 | Pst 16 | Pst 18 | Pst 19 | Pst 20 | Pst 21 | Pst 22 | Pst 23 | Pst 24 |
|---|---|---|---|---|---|---|---|---|---|---|---|---|---|---|---|---|---|---|---|---|---|---|---|
| Ep007 | + | − | + | + | + | + | + | + | + | + | − | + | + | + | + | + | + | + | + | − | + | + | − |
| Ep020 | + | − | + | − | + | − | − | − | − | − | + | + | + | + | − | − | − | + | + | + | + | + | + |
| Ep017 | − | + | − | − | + | − | + | − | + | + | + | + | + | − | + | + | + | + | + | + | + | − | + |
| Ep019 | + | + | + | + | + | − | + | + | + | + | + | + | + | + | + | + | + | + | + | + | + | + | − |
| Ep021 | − | − | − | − | − | + | + | − | − | − | − | − | − | − | − | − | − | − | − | − | − | − | − |
| Ep022 | − | − | − | − | + | − | + | − | − | − | + | + | + | − | − | − | + | − | + | + | + | − | − |
| Ep023 | − | − | − | − | − | + | + | − | − | − | − | − | − | − | − | − | − | − | − | − | − | − | − |
| Ep024 | − | + | − | − | + | − | − | − | − | − | + | + | − | + | − | − | + | − | + | − | − | − | − |
| Ep001 | + | − | + | + | + | − | + | + | + | + | + |  | + | + |  |  |  |  |  |  |  |  |  |
| Ep002 | + | − | + | + | + | − | + | + | + | + | + |  | + | + |  |  |  |  |  |  |  |  |  |
| Ep003 | + | − | + | + | + | − | + | + | + | + | + |  | + | + |  |  |  |  |  |  |  |  |  |
| Ep004 | − | − | − | − | − | − | − | − | − | − | − |  | + | − |  |  |  |  |  |  |  |  |  |
| Ep005 | + | − | + | + | + | − | + | + | + | − |  |  | + | + |  |  |  |  |  |  |  |  |  |
| Ep006 | + | − | + | + | + | − | + | + | + | + | + |  | + | + |  |  |  |  |  |  |  |  |  |
| Ep008 | + | − | + | − | + | − | + | + | + | − | − |  | + | + |  |  |  |  |  |  |  |  |  |
| Ep009 | − | − | − | + | + | − | + | − | − | + | + |  | + | − |  |  |  |  |  |  |  |  |  |
| Ep010 | − | − | − | − | − | − | − | − | − | − | + |  | + | − |  |  |  |  |  |  |  |  |  |
| Ep011 | − | − | − | − | − | + | − | − | + | − |  |  | − | − |  |  |  |  |  |  |  |  |  |
| Ep012 | − | + | − | − | − | − | − | − | − | + |  |  | − | + |  |  |  |  |  |  |  |  |  |
| Ep013 | − | − | + | − | − | − | − | − | − | − |  |  | − | − |  |  |  |  |  |  |  |  |  |
| Ep014 | − | − | + | − | − | − | − | − | − | − |  |  | − | − |  |  |  |  |  |  |  |  |  |
| Ep015 | − | − | + | − | − | − | − | − | − | − |  |  | − | − |  |  |  |  |  |  |  |  |  |
| Ep016 | − | + | + | − | − | − | − | − | − | − |  |  | − | − |  |  |  |  |  |  |  |  |  |

(+) indicates lysis of the bacterial strain by the isolated phage.

Example 4

Culture Conditions and Synergistic Activity Of Bacteriophage Combinations (Cocktails)

Materials and Methods

In order to examine activity of isolated phages or bacteriophage combinations (cocktails), different strains and species of pathogenic Pseudomonas bacteria were incubated with single phages or combinations of phages. Bacteria were isolated on 1.5% Nutrient Agar (NA) plates by streaking bacterium of interest from frozen 25% glycerol stocks on a 90 mm round NA plate using sterile inoculation loop. Plates were incubated over-night until individual colonies are visible and examined for purity. Using a sterile loop, a single bacterial colony was transferred from a bacterial stock plate into a 15 ml polypropylene culture tube filled with 5 ml of Nutrient Broth (NB). Tubes were vortexed and incubated over-night at 27° C. in shaking incubator set to 180 rpm. A similar tube was used without inoculation as negative control and as blank sample for Optical Density (OD) measurements. Over-night cultures were diluted to $OD_{600}$=0.1, then grown in shaking incubator until $OD_{600}$=0.3, which represents approximately $10^8$ Colony Forming Units (CFU) per ml, at the logarithmic growth stage. 96 wells plate was used for growth curve assays. Each bacteriophage within cocktail was mixed in a similar amount of bacteriophage particles or Plaque Forming Units (PFU) to establish a consistent Multiplicity Of Infection (MOI) against the bacteria. Positive controls included 200 ul bacteria. Negative controls included bacteriophage lysate without bacteria and 200 μl of NB. All samples (phage treatment and control) were performed in triplicates. Plates were inserted to a 800TS Microplate Reader using GENE5 software (BioTek, USA) and were incubated in plate reader at 27° C. for 24 hours run with continuous shaking set of 180 rpm. $OD_{600}$ levels were examined every 15 minutes. At the end of the run, data was extracted to Excel and analyzed for growth inhibition of treated bacteria. Bacteriophage groups F, G, H, I and J were tested with 14 *Pseudomonas syringe* pv. tomato (Pst) strains, internally named Pst 1-14. Host range profile was defined by examining all isolated phages activity on all target bacterial strains. Subsequently, combinations of phages were examined to reveal phages synergy while optimizing maximum pathogen bacterial host range. Most lethal combinations which covered the widest host range were chosen as representative cocktails for in-vitro and in-planta experiments.

Results

Figure 2:
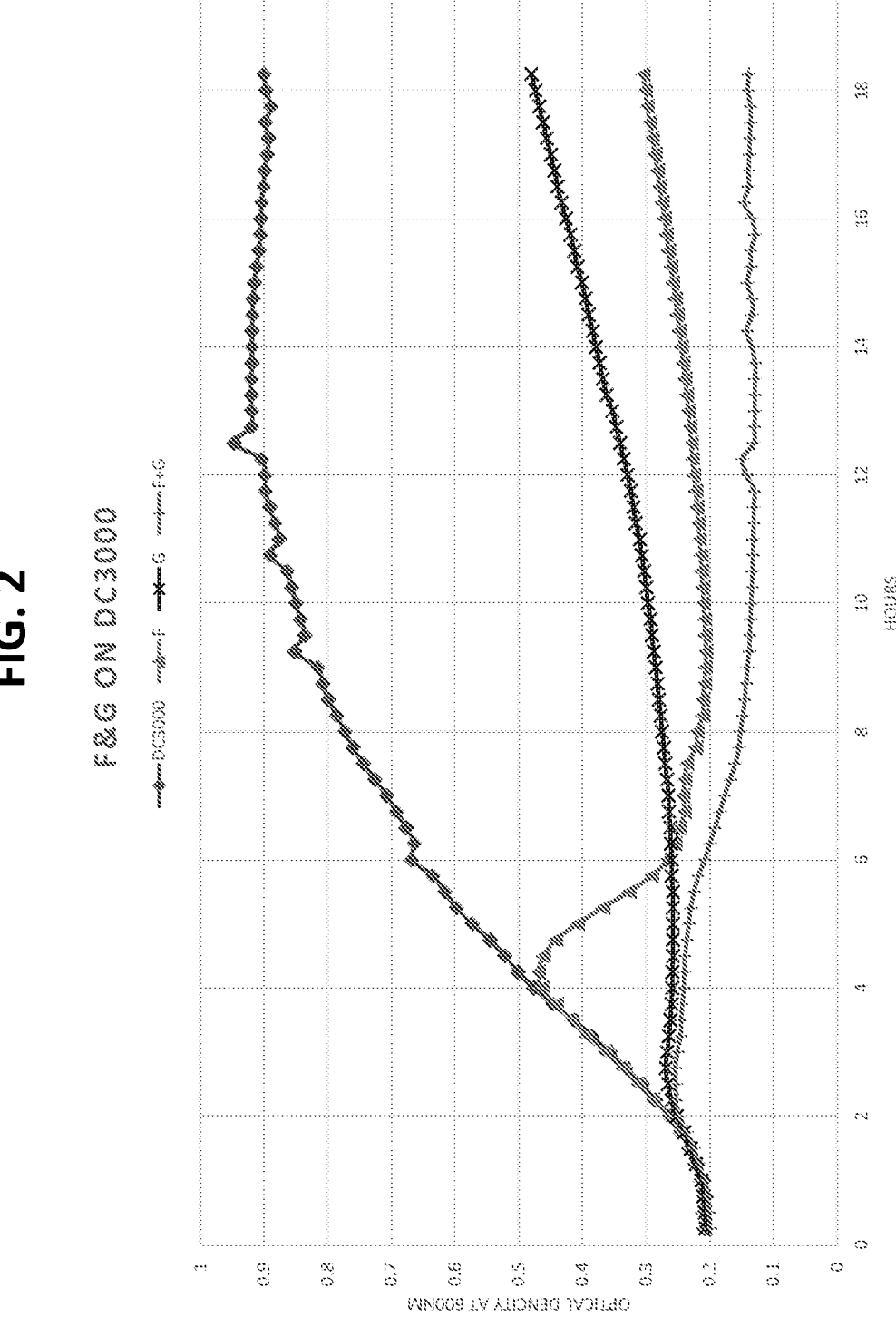
FIG. 2 is a graph illustrating synergistic activity of phages EP007 and EP009 (group F and G representatives) targeting Pst13. Activity of phages EP007 (F) and EP009 (G) against bacterial strain Pst13 was measured for each bacteriophage individually and by combining the two phages. A culture of bacterial strain Pst13 at its logarithmic growth stage was diluted to $OD_{600}=0.3$, and 180 μl of the diluted culture were applied to each well. Each well was then supplemented with 20 μl of one of the phages or a combination of both phages. Double bacteriophage cocktail (F+G) shows lethal and immediate effect on target bacterium with no resistance development within the 18 hours tested.

*Pseudomonas* phages: Phages from F group (infecting pseudomonas bacteria, FIG. 1), exhibited the widest host range in comparison to other phages. Bacteriophage Ep007 inhibited growth of almost all Pst strains (except Pst 2, 7 and 11). Bacteriophage group G, inhibited Pst 7 and 11, and bacteriophage group H inhibited Pst 2. The combination of the phages from groups F, G and H covers the full host range of the pseudomonas bacteria from the EcoPhage library. The synergistic activity of phages EP008 (group F) and EP009 (group G) is illustrated in FIG. 2.

Example 5

Phage Cocktail Protection and Prevention Studies in Plants

Materials and Methods

*Pseudomonas syringae* pv. tomato bacteria were grown in Nutrient Broth (NB) medium and Nutrient Agar that were prepared according to manufacturer recommendations. All cultures were grown at 27° C.

Assessment of Disease Symptoms Inhibition in Tomato Plants

Tomato (*S. lycopersicum*) cv. 4107 seedlings (Yarok2000) were transferred to plastic pots (7*7*8.5 cm, 1 seedling per pot) filled with a commercial soil mixture (HR2 and agrimix). Plants were grown under long-day (16 h light) conditions, at 25° C. and were used for inoculation after developing three-four fully expanded leaves.

One day prior to the start of the experiment, the bacterium (*Pseudomonas*) was grown in liquid NB at 27° C. whilst shaking (180 rpm). On the day of the experiment, bacteria were centrifuged, washed from NB, and resuspended in new NB to reach an $OD_{600}$=0.6 (~$10^{10}$ PFU/ml) in a solution containing $MgCl_2$ and Silwet L-77 in sterile distilled water (DW). Bacterial concentrations were verified by CFU test.

For bacteriophage inoculation, a cocktail composed of 1:1 ratio of each bacteriophage (~$10^9$ PFU/ml) was mixed and diluted 1:10 in bacteriophage solution containing appropriate sugars, in sterile DW. Bacteriophages titer was verified by PFU tests.

The plants' foliage was submerged for 5-10 seconds in bacteriophage solution with bacteriophage cocktails (treatment) or bacteriophage solution without bacteriophage cocktail (control) and left to fully dry (~1-2 h). Plants were then sprayed on both sides of the leaves with bacteria solution by spraying, until slight runoff. For a double bacteriophage treatment, plants were additionally sprayed on both sides of the leaves with bacteriophage cocktail solution until slight runoff. All plants were left to fully dry for about 1-2 hr and transferred to a growth chamber at 25° C. with long-day (16 h light) conditions covered by plastic lids to increase humidity for 48 h.

Disease severity in each leaflet was determined every two to three days after the appearance of disease symptoms (5-6 days post-inoculation) using the following scale: 0—healthy leaflet; 1—less than 10 dark spots; 2—between 10—30 dark spots; 3—over 30 spots without yellowing or browning; 4—over 30 spots with slight yellowing or browning; 5—over 30 spots with significant browning/necrosis that covers less than 50% of the leaflet; 6—over 30 spots with significant browning/necrosis that covers more than 50% of the leaflet; 7—more than 90% of the leaflet is necrotic. In each experiment, each treatment was applied on 5 plants.

Disease inhibition percentage was calculated as:

$$100 - \left( \frac{\text{disease index of treatment}}{\text{disease index of control}} \times 100 \right)$$

Assessment of bacteriophages possible phytotoxic effect was performed by following the appearance of symptoms in plants that were dipped in the bacteriophage cocktail, left to dry, and then sprayed with 10 mM $MgCl_2$ with 0.025% (v/v) Silwet L-77 without bacteria. In each experiment, each control treatment was applied on 3 plants.

Results

Figure 3A:
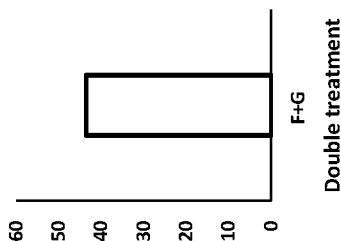
FIGS. 3A-B. Bacterial Speck prevention using bacteriophage cocktails treatment in the tomato-Pseudomonas pathosystems. A—Cocktail of phages EP007 (F) and EP009 (G) targeting bacterial strain Pst5 was examined. Plants foliage were submerged in bacteriophage solution with either bacteriophage cocktail (phages EP007 (F) and EP009 (G)) solutions or experimental solution without bacteriophage cocktail (control), then inoculated with bacteria. Left panel: disease index as determined according to disease severity scale. Right panel: disease inhibition percentage relative to control. Bacteriophage treatment showed approximately 40% disease inhibition. B—Images of representative leaves of plants treated with bacteriophage cocktails or bacterial control were taken 12 days post inoculation. These results show bacterial symptoms were significantly reduced as a result of bacteriophage cocktail treatment.
Figure 3A:
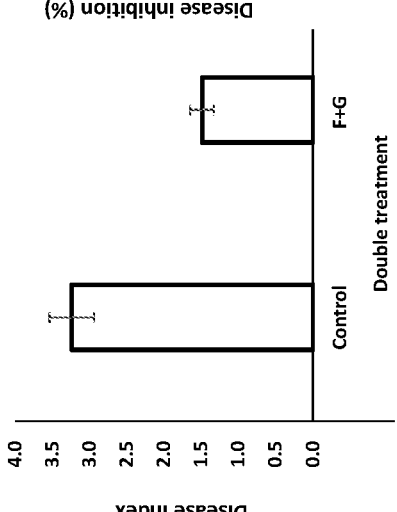
Figure 3B:
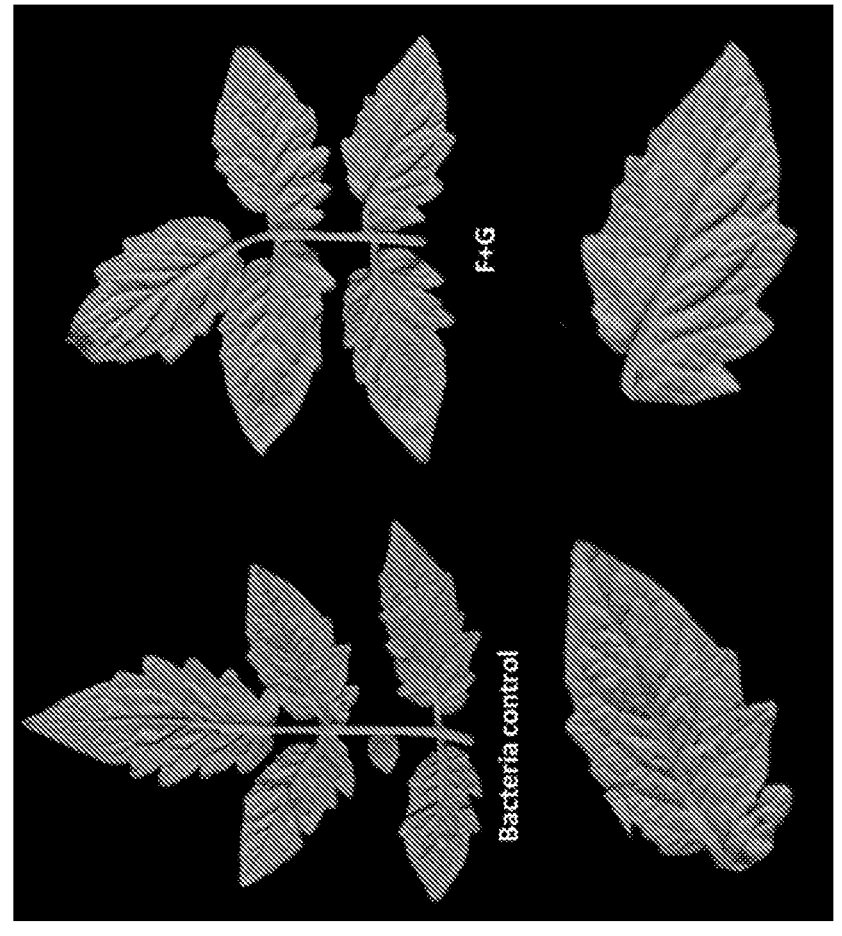

The results illustrated in FIGS. 3A-B demonstrate that treating tomato leaves with a combination of bacteriophage EP007, EP009 and bacteriophage EP012 (groups F, G and H) can significantly reduce the symptoms of the bacterial speck disease caused by the Pseudomonas bacteria.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

In addition, any priority document(s) of this application is/are hereby incorporated herein by reference in its/their entirety.

SEQUENCE LISTING (41 sequences)

SEQ ID NO: 1 - DNA, 41379 bp, unidentified
  misc_feature 1..11: note = bacteriophages nucleic acid sequence
  source 1..41379: mol_type = genomic DNA
tgacgtagcagaacgtcatgtcataggtcgctttgtggtacgactcgatgtccttgatgcggccatagaggtacttggcgcgctctacacgctcaggtgcagcgaggcccaattggacctcagggatgatcttgtcgaactccacacgaagcgcagagacctcctccatgagcaggttccatgcctcgatctgcgattggtcgggaccggcatactcagggatgtccccagcgagcccccggtcgatgatctggaatagttcattgccatgcgcaacttcgtcgccacgcacagcggtgtactcgatgtagtcctcgatgtccgagaactttacgaggcagtaggctgcatccttgttagggcagcaccattggacattcttcacgtccacgatagatctgttagccattaatcctccttacgcatagcgcatgtatagggtcacggagtcaggggatgcgccgtcagcgttaaccaacttacccatccgaacgtagttaccggccaagttgtagccagcgaagtaagtgccaccagtgttggtgccagtgaggttgccgccagcgacaccttcgttccactccacgcccgagttgttgtgagccagagccagcatgtggcagcccagcgagttgactcgcagactggacatggcgatgccaatgttgttgacgttgcgggcttcttgaacggcccaagcgtttgcacgctcattggcggtgttgtagatgtaggtgttcgcccactggttaccgaaaacggaaccgaagatgttcccatccggggagatctgcatgtactgcgcggcagggttgccccagcacaagtgaccggcagagttcatcatcagcttagaaacaacggtcgcgccccagtggaaggagatacccggtgcgttgtagatgtgacccggagctggtccaccattacctacgaggccgctctcacgaatctcaaaggcaccgttgtaaacttggttggcagccgagaggttcgtgtaggtgacgccacagacttgattgttgttgcccatcgttgtggtcccaccagtaccacccagtttgtaggctgggttgaagttaccagttgaccacacgcggttacctgcatcccacacaccaccagtgcctgagtagatgccggaggcaccaccagagtagagcgcaccagagaactgagcaatcgccccatctttggtcatttgcaggagggcaccagcgccaccaccacccgagttgccccaatggaatgtcaacgagtgaaccccgttcgtattcgtaaggacgcccatagaggcagtctcaccgacaccaccttgactgtacttgcctttaacaatcgggtagtacgctgagacgttcgtgagggccttctctttggacatgaatggggcagtggtcgcccattggttggcgaagccgttggcctcatcataaggctcagcctcaaagcgcttcccaaggaacgcaccgacagcctgtacgatgcccttaaagaccaccttccagttcccatcaccgctcgcagtggacgagatgttgtcgccaataccaatcgcaccgcccaactgggaagcgcttgtggcagcctcagcggccttgttggttgcgatggtcgcctgagcagcagcgagactcacttgagcctgagcatcggtcaccttttgggcagcctgagtggcagacgatgaggcagcgttggcgtagcccagagcggtagccacatgggcgattgccttctggacccagtggtaggccgagtattgcccggtattgaccacggtgttctcagggttgttggcccacttgtaggcagtctgattggacaactcagagtttgtcgcagaggcagccgaggcgttcttagcggtctccgaggcaattcgatgggtgtacgattcgccagcgtaagtgatggacgtatcgcgggcactttcagaagccagccgggaagcctgagaggcagccgcagaggcagccgagaggttcgcttggttgagcgctgagccgccccattgttgctcttggcgcagggtcacagcgtcaccggggttgatcgcatcagcgaggttcacaatacgccgcgcacgggcatcgagttgaccatcgttgttcacgccgattgtgtcagccgtgaggtcacgagcttcctcagcgatgtggagcgattgaatctgagcggtgttgaggtcgtaggcccgaaggatcgaaccgtcagcaaagtcaacgagacgctcagtggcggaagtccaacggcggatctcgatcaggtcgaagttgtcagccggaccccagccagaaccacgcaaggtggtgatggtggttggagtggagaagcggaagtctacgttgagtacaagctctttacgggttgcgccgatcaagttgacactcacgaacttacgagcgagatactcgaatggaatcgtgaagtccttgagggaaccgttgagggcatacgtcttcaccgtcttggtggtagttgccatgtggtctccttaatgaaaaagccccaccgggttagggcagggcgtgagttgatgtatcccaatagtgaggggttattaacggaccttctggccgcgcttgccgtactccatgcccatctcttggaaaagcatgttggtgaccttctgagtagcggggtcgttcggcacgaggttacggaacccgttgtagatcgcagacttgtagtcctgatcctgagcccgaccctcatcgcggaacacgccagcggtgccattgccaatctgatagatcgacccgaggactccgaggccaggtacttgctcagcgaacttcgagagtgggtcttggatgcccgaggagcggagcggggaatatttcacagcccggttccgttcggtgtactgaggaccacgaggaagaacagaggtccgcacagcagcggccgcatcgaaccccagaggggccagagcgaagttggcgatacccaaaggggcaccaacgtgagagctacgagagcccgctgcataagcgatcatgttcatgtccagtgaccgcgacaggaagtcacggcgttcctctttaggcatcccttgagcttggacgtagcgctgggccacatagaagcccgaggcgagacccatcgagatcgccacttgttgggcttggtcgatggcctgcttgttcttggtggcgttatagaagccccgtaggaggcgactgtttaccgaacgcaggacgaagttcttgaactgcatcgccaacttgacccaagcgttctgcgcaatggcatcggtgttgctcagcttgtggggacgcaggatggtctcatcggccaccttgtcaccaatccgccagatgtccattacccgagggtcttgttggaacttggcccgatcacggatcttgaagccacctttgggatcagccacgagatgctccttgagggcattcgtcacgtcaccgaactgagccttggtgatcgacatcgagtgcagtcgatcctcattgaacagcttcgaggtcttcccagagagcgcatggttcacgaggtccacaaggacaccttgccgaccagcatcgaggatgtagttggaggtctcagtgaggaacttggtgaaaggcgaacgggcagccagctcaccagtggcgaacttgatggtgcccacagtctgagccgtggccccgctgtagccttggttacgcaggcgttgcacgatgtcagcacggcgaggacggatgaggtcatccagctcccgaccgaagatcatgtcgtgcatctccttgagttgctcaggtttgatcttggagccccatgtggtcatctcacggaggaaggggactcccttcatgagcatccgagtgtggcccttagtgatcagcccagcgatctcagtgacgttctgagcgcccatgtaggcgttcttggtgaagaacgaaacgtcagtcaaggcacgagccagtgtggcagccgctgagtcagggtctcgacgtgagcgcccagtgagcagcttgatggactcctgcaaggcttccacttcctgagtgttgccattcttggccttgatcttgaggatcgcgtccttgagggaagtggtgtccttaccagtggcagccatgatcccgatgtccccatttactcgacggttgtacgaggaggtgatctgagggacgtcaaagatgcgcaggtcattaaccgagaaggttgtcccatcgctcagcgatacagccacgtccgagtcaaacaggtgacggccttcgaggaagttgttggcatcctgacctaccagaccttcgaggttatcgtcgatcagcgaggagcggttgaagtcagtcgtgtggctgataccgtatgccttgttgtaggcgtactcagtgacggccttcttgatgtcctcaggtgttgccaccttgccgttcttctccagcgactccttgatcatcttgtccactctggttttcacagcagcacggctcagataggaagccatccagctctcaacgattgccttctgcaaaccctcaggaccgccgaagcgttggaggttgagcagcttgatggcgtcatcgtagatgttcgggatgtaccggccagagtgacgggtctgaggcatgatcgaagtggcatccatgttgccgtactgcgcagggttctcaagggagttctctttgcggacaaagtgatcctcgacaaccttggcgtacttcttctcagcctcagtgagctgagccagcttggcccctgtagggtcttcgatagcctcagcgatacggcgatccacatactcacgctgagcctgacggccaccgggcagggtcttcaccgagacatccttcatggcttcttgttgggcatcgaccatggcgtttagagccacatgatcttgaccacgctcacgctcgatcacgtcagaagccacagcgccaaacttaccgttggacccagagacgccaccagtaggtgaacggaacaactgagcgccaatgcctctcagctcctcgtcctcgctacgcagcagcatcaggccgatctcagtaaggcccccgaacttgaacccagcagcggctcgctcaggctccagagaggccatcgctttgatgagcttagggttcagcgggttgctggcagagaggatcgaaccatcaggcagacgcacagcgcccggttcctttgggtggtccatgtactgaatcccgaaggcttcgtcaggggtctcatcggacttccatgccataacggtagggtcatcagcaccagccaaacgagcttgctcacgggcattgatgcggatggttggacccatgaactcgttcggttggctcgactctcggtgcctcgcaaggatgccctcaacggtgtcgtcagagacttccattcgaccctcttgtttgtgggagcgctcaccgtgcatcccgaggatcttttcgaggtactcatcgtccatctcatcgtcaaccttagaggggcgagcggaagccagcatgtcctcatcgactttgacatcgttggactggaggccagcctcaccgtggcgagcaagaaccctttcgagttcctcatcgctcatgtcttctcgcccaggcttaacgagtgacttggcaatccacttgtccaagacagcggccatggtgccaccgatcacagcaccacctacagcagcggtagcgtagtgaccttcgatcccagtggtcgcctcacggatgccctcaccagccacagcggcaccagatgagaacgtcccctgagccaacacacggccaccaaaggttcgcagagcggtgcccggaacagggacgtaggtcagtgggtcagtagcagcgagaacgccaccagcagccaattgaccgccccagccagcggaggtgatggtcttgtcgtgagccatgttctctttggcgagagcgatggcctcaggcagcttgcgcttgtcgtaccgggtgtagtcaccaatgaagtcgaagtattgcgaatcgacaccttcattacggatgtggtcgtagtcctccttggaccactcacggtcgcccgtgtcctgcatccactccagtgggtcatgatcctcgacggtgatgttccggtagatctggccgggaagcgaggtcttcaaggcagccaacatggcctcagaggagccgtaccatgcgcccttctctgggccgttctgctcgatctccatttggcggaacgacttctcttgggcaggcgcagtggagcccccgatgttcatcccgatgtttccaccgaggctaccttgttcaacggatggtgttgctgagatcccttgggtagcctcttggaactcagcggttagctttggggcatctggaccctcgaaccacttgcgggacggagagtcaccagccacgtccagaaggttcgccatgtactgacgaccctcaggggcgatcttggagaagtcaccacgatccagcgcttgtaactggggagcgcctaagcggccattcccttggttgtacgcaagggcagccttgaggtagtcccctttgtaggtcttgaggaggtccgcagtgtggcgagcggacgcattgatggacttggcagggtcgaagaagtcctcgtctgtaacgagaccatatgccttgccagtggcacgagtgaactgacccagaccccgaggcccagtcggtgactgagcttgagggttgaagctggactcgttaaagatctttttgtgcaggtagtcatagctcacgccattggcatcagcagcctcacgaatcaaaccatcgtaaggcgtgccagcggccttgacatcagcgtaggttttcttagccatgtgttcctcctaaattggattagagagggccacgaccccctcggataaagtctttgtagagaccttgattgcgttgtgcgtccttcacgtcctcatcgtactcagcagccttgttggccttctgagcttccagttccgcctgacggcgagcgctgtagatgagctggagggattgcttcttgatggtcacgacctcaccagtcaaggtggagatcttgatgtcaccagttcgagaagcggtgatggtcacaggcgagtcagcccagtacgggtcagcagccttgatgcccttaacggtctcctcaacgatggccttaccctgctcccacgagttaacgtcgttcgggtcggccatgagatccttcttgttgatcatcccttgatagccggtctggacatcctcgtcgtcatcgccagcttggaagctaacggtgttcttcgagagccagttggagagcaacttggaggcagccgttgggtcgccagttgcagcgttgaaggcgtcatagagagaacgagccatggtgtccatgtcgttcggaatcgctgagaggtctttgttcttagggtcgctcttgagggcatcccattggatgttccgttggatcatctcctccttggtcagcttggagttcttcacgtcagccgcaatgaggaccgatgggttaatcccaacgtgcttcatctggttcatcttttcgatgaagccagctcgctcagggtagagtgacgcaatgagttccggttgctgggcatagacccgtgccagttggtcgatctttggggagtccccgagttcgcccaattgaacagcgccttgccactccttggctgcatcgtcgatcagcgtttggaagcctcgacggaagggaccattctcgtggtcgtccttgaggagttggcctcgctcaagatccttctgctccacagggatgtccatggcctcgatctgagccagcttcttttgagcgtaggtcgcccagtcggactccttgaactctccagtgttggcatcgacaggcatgtcctgcttagcggtccccaatagggcaccattacggcgagccttgtagcggtcgtcgatggcctgcaagcggttgtccgtctgcatcgcctcctcggttgccttaagggtagcctgagtgtgggccttcatctttgccagcatggcgagcttggtactggtgaccgcctgcttttgctgagtgaagccatcaccatcctgaatccacttattctcggcctcgatccgattgatcatgtcccaaccacgagccgggtcagcctgagcctcagccgaagcgagatccagttggaacttctcgaactttggttggttgcgcttgtaggtggcctcagcggacttggcgatcaggttgtcgtatttctcctgaccgatcacgtcaccgaccttctgctcaatccccatcacggtgatcgtctgatctcggaagttcttgaggaaggtcgatccgtggtccttctggaccgcatcgttgatcacgaggttgactgaatcgaggagcgcttggtccgttgggattgccccagaggatgccttcgatttgaagtaggcagccatctcgatgccagagcccggaccacgcatgaactcagggtcatccagaagaccaccagtgtcgccacgagtgttgaccacagtctgagcaatgtagcgctgggaacgtcgctggtcatgcaagtcgaataggcccgcattacgcttcacgatgtcggcgttaaagccacgctggtagtcaggatcgttagggtcaatacccgcttcctgagcgtaggactgagagaccatctccagacgggtccggcgatactcatccagttcctcacgggattggttgtcgaactcaccagaggcgagcttgttctggatctcggactccacctcaaaggcagccgtccggccagtgtcgtgacgcaggacgttcatcacgtcagggtcatcctgtaggtgcagggttcccgctgcgatagcctcacggcgttgctggagggacatcgaccggatgatcttgtccgactcagcctgagcgttcttcgccttgtcctgagcgtaggtgccataggcattcgccccggccttcacgaagctcgccatggagtcagcgaagccattgttgcccacgtcagcgcgttgctgagaggcttggaactggacggtcgcagtggagcccttaaggcgttccttaccgcccatttgggccgagtctaaagctcgtgcaatttcattagccattaagttcctcctttagctgtaccgttggattgtccagttgccttgttggcgttcatctgaccttttaatgacgacccagcggcgtagccattggcccccgcagagacgatcccaagggcatgactcagaccactggtcttgatcacttgggcctgacctttgagggccgacttggtgttctcgacgttggcaatctggttcgcaaagatcgacgaatagtcgcgcttgtagttgtcggtgatcgccatcttttgttgactggcctcgacatccactgagttcgcaatacgcttgatggagttgcccgaaagcattgactcaccgatggcagcagccaccgttcctttgttcttgagcgcctgcatgttgacctcagcgagttgcgctcgggcctcctcttggcggtcttgggcagtcagttgcaggttggcgttagccatgttggtctgcttgacttgctctcgggcggtgcgacgttgagcatcctcagcgttaccctcacccttggccttgtccttggcagccatagccccaccgacgaccgcaacagcagccatgccgatgcttactggttcacacatggtgacctcctatagccagaattgacggaaccgacatccggcaggactcatgtggtgttcacgggcgaaggtcgcaccgagagcgttgaggagacggatgtgggcgtgattgtccactgacacgaagttggtcagggattgatggccttgcagcctgagtacgctcagatgccctttaagcatccgatagaactccatacgttcagccttggtcagcaggcccaccacgttggtagtcacaaaccagaggcaatctttggacccacctacagccaccaccagagcgcccttagtgatcaccattgaggtgtcatcgaggcagttcgggatggtgtctcgtggatcgcgcccagccgtgtgggagtggaactcttggaggtcaccgggactgaggtctcgtgcagcagcttcgaggtgccagcgttgtgctttctgtaaaatcataaagatccccccatagggcaatagtgagggtaaataaacccccaccatgccagtcaattagataccgccagaacggcgaatgtagttaccttcccatccgcatccgatgatgttgagtgggttagggtttgcagaactgatcgtcactcgttgtgcctgggcgttgccggtgacagggaacttgaactgcccggtccccagagccagctcaccgaggaacgtttgagtcccgaggcgaccaccagacatcgggtagacgtactgagtggagccgttgttgacgttgacctcaaacgcgccagagttctcatagttcaaccatgctctccgaagctggagccgaccgatgtcctcagtggaggtggagccatcgtcagcggtctgcttgatgaggaacttggagaactcatattggaactcgtactcacgaccgaagaccacatactcaccagcccggttgcccggaaaggacaagccagaacccgaaggccatggaccttcatgtcgctgcatcacgccttgctggtcaatcgtgtagaacacggagtcgcccgatggcaggccaccgagaatggattcgatgctcacgaagctacggtggaggtcgatgtcataggcaccgatctggatgagcttcttctggtccatgtaggtccggtagggctcctgagcgatgtcgatggtggactgagtgaactcaatgcgctccatcatgatcccctcagggcgatccaacatgaggtacatgtaggagccaatcgagtacgcagcgaggatcttaacgttggtcccgaagttccagtgggagaacgattgttgctggaggatctcgtcgaggtacaggaacttgtagatgtacaggttgcccggttgcccgttactgatcatcgacacgaagttctcggttcctgaccccgccagattgaacacggtgtttggcaggtagctcggaacgtgtgcggagacatcctcagcggacttcacgttgctcacgtcttggatcgcgtagtagcgcttgagggacgtgtaggaggcccgaggtgcagcgaagtaaaccccgcgaccaataccgaatggacgggcaccatcagagacatcgaactcagtcgtcaagtccaactcaatggtcttcgaggagagaaccccagcggacgacaatacgaactgggcttggtccgaccacaacagcaattgctcagcgaacggaacggcatacttcaagatgctcacacggttgtgcgagatcgctacgtcaatcgggtcgtcatcgctaagagcgctcacggaggccgggaagaagttgaagtatttagcggtcctcgacatgatcacgttctcgcctgcaatgaagccaaggcggttacggaagaagaagatgtcgttgatccgatcaccaatgaatgacggcattgggttggttccatcgtcaccacactggcgcgtatcccatgtcagaggggtccaatcaaagttaccatcagcggcccggatgagggcgtgaggcatggtcgcactattgaacccagcgatgatccccggcttcgccacctccttccagaccttaccagcgaggctgtattggacccagtagttgtcgccagtacgagcggactcgccagtgacttccacgaggtatccatcaggggcctgagcgggcaacttgttgaacgtctggacttggtagatgaagccgttcatgagctggtcaccgtagccatccttggtctgtagcgaaacaaacccaccggggccgggagcggtgatcatgacccagccggggccagaggttgccgaccagcccgaggcgttgagcgcagtgttgatctgagcggccatcgttgaggcgatccagttggcgtccgtcatgtccacttggttcatgccagcgtaaggctgcccagcaggcaccttctcagcggaaccgttaggcatctggatgttcccgtagacgcccccgttgatgaggatctgcatggtccggccatactgcccaccacggatgttcacaagcccacgagtggtcacgttaggttgtccagcaccagtcagcgtaccgcccaactgagtgacagtcttacggttggtcacgaaggtgtagtcggccacggtgatcaacctcaggtcatcacgagggttcgcacagttggcgtagccgttgtaaccacggaccagatactcattgccagccaagtcatgaaccgtaaggccggacccgaagaacgacacgaagtattgctcggtggagtcccggttgatcatgtggaccagaggcttcacgcccagtgcgccagtgctgtacagacgcttgatgatcttggtcggtggtcgcttctgtagaccctgagtctccgaggaccagccattgatttgcatggcaccttggttggagaaacgcaagatgtccggttgctgcgagatacctcctttgaggttcttgacgctttgcgaaacgagtcccataggccctccttagcggttggtgataccaccgacgaacgcatcgcctgtgatcatgttgaagccaccgaagtccagctcgtactcttggatggacgcccaagcctcagcctcttgttcctgcaaggagccctcgatctcaccagcaccgaagaaccgggtttggaatcgacgagaggacttagcgacgatgtacgagcggaaacactcgggcatctcagagagttgcttgaggcggatcaggtccacggtgattgggttttcaaagacatcagtcttcgcggtgcggtcgtaaacgaatccaccacggttgatgtacagggtgccgcctgaggtggtcatgcgcaggtagtcaggcaggtactcgatgagcttcgagaaggcgtcagggagaaggatcgcgccctcctcaatgttgaacgtccagcccttcgcttggatctcacggttgaccttggagagaatgcgacggcagttcgctacgtcagcgttagggtcaccttcgagggaacttacaggggactcaccgatggcagcgagcatgtcattgacagcatcgagttcgtcatcagagtcgaggaccgattcataggccatgttgatctcctttcgttgaatgaaaaaaaaccccaaggagcccggttaggagccccaaggggttagttggctttaggcagccggggtgaagaccagcgcaccagcagcctcaggacgcaggccaccgtgacccatcgcgtacttgccgatgatctggtcagcttggtactcaggacgacgagcgcgttccagcgccatgtctttcagcttcacggtgccgacagccgaacggtgaaccagcaagccgatcacgttgttctgagctaccttgacatcgccagcagcagtggccgggaaggcgtgcttctggttagtgccgaggtcgtcatcaccagcaccgccagcgaccagatgtgggacttcgataacttcccagcccatcacgttgcggatgttgccggtctctgggtcgatcagtgccgagtagttggcggcgttcggcatcagagcagacaggatcgcgctgtagtcgtcaggggaagtgaagaagcgacggtcgccagcagggacgtagttcttggtgaagcggccacgggccagagtcagacctttcaggatcgctttaccacgagcctcaacgtcaacgaggtcagcagcagcaccgatgttcagaacaacggcagtgcccagaccagcgatgttctcgttggtagcggcaggcaggttgcacaggttcgccatctcggccagtacagcaccgtcagcggccagagccagagcttcgcccagttgtgccgagtattcagcacggacatcgtagtggttcatcgcgtcttcgatgtcgtagatcagaacgtccgaggtcaacagaccgtcgatctggatcactttctcggagtgcttgatgtctttacgcttgtcgtccaggttctcaccagcagcgaggtagtaacctttggtacgacccataacagggaacgaagcggacttaccattctggatggtacgaaccatatgcttgtccatggtcacggagcgacggacgaaagccgtcaggacttcgccaccgaacagcttaaggaagttcgccagtttgtcagcagggttctggcctttgccttggttcgcgccgagttgttgaccgccattcatgttcgccatgtattagttctcctttgtgaaattcttaagggcgcaagagatcctccgaaggaatcggataggtatctctcgcaatagtgagggtttattaattaccagttggtgcgcagcactcgggcttcgacttgggcacggtaagatgggtcggtagcgtaacgggagtctcccatcgcctttaccatctcggcctgagacgcatagccttgtggaccttgaggggcctgtttaggaccacttgcaggggcacgcttagtgacgctacgttccggtgtcttgccgaacttcttggtgcggctcgccatgcccagattgatcagcgtcttgatggacgcaaggtcttggttctggatggctcgctccaatgcttcaacagcatcaggggagttggccgtcatgtgagccacgatggctttgaacttctcgggaccaccagcgtattgctggatctgggccacataggtttgagccagtgcttcttgaccgctgataaacgacttcacgaagccacggctgtagccaaccttctccagcgcctttaaggacgcctcagagagtttgttgtcagcttcatactcggcctcgatctggtcagcgacctcttgtggcaggcccgctttgatcgcttgagcgcgcatctgagtgaatccatcagcgtactcatcgacggcctcagaggcttcgatcaggtcagcgtcaggttcgcccagagggacgaactcatcggagtcagcaccttcgtcagtgccctcctcgttcgtcaattccagctcttgagagttgtcctcgccggtatccagttgcagctcgttggagccttcttcggcgtcctcgtagtgcatctcgatggagtcatcgccatcacgaacagacacgggcattgccagcatcgcttgctcatgctcggtgatgttggtagtggtcatcacagcgctattcacgccgaagtgtgcatagacgtcagcttgggattcgttgctcattgggtctcctttagaaaatggagagacacacgcctcgggcactatccgaggtttcccagatgtacttgcttggcagaacgtgtgtctcgcaatagtgagggtttattaaatcggggccgcttcgatgcccgtagtttccatagcgccttggatggcctctggacttgcggtcgcttgttgagcgagaccctgaccgatgccagcagcagcgttgaggccaccttgcttgagcatctcttgggattggagctgagccttctcggcctcagtgagcagcagaccggacgtgtcgatgcctatagcgttcgccagtctcaacttgatgttgctcatgttgaggtctggatcagcctgtagctgactcacgttagccattgcgctcaagaactgattgagcttgtccaagtcctgaccacgacccagtgcctcgacaccagtgctgacagttggctcaacggcctcctttggcatgtctgggatctgcgaggttgcctgtagttggttcaacaggatgcggacgattgggagttggagttcctgagagagaatcgaatagacgcccccaagggtgtcctcaagttcactcgccacatagcggatctcctcggcagtcacacgttcgcccttgcgttgtaccgcagagttcaacatgaagacgtaggagaggcgttgctcaatggcatcagcgacagacttagcgactgtgaagtcagcggtcttctccaactggaggaactcgatgtcggacttcttaccggcaacaaagtcgccagtctgagccttcaccaaacgacgaacctgagtgacaccattagggttcaccagtccgatcaccttcgaggcgaccatcgagaacttgatcatggcctcatggagagactcaagggagttcaggtcaccgaggtattcctcgacatgagagcggccataatgctcgccatcacgtttggtccagcgcacagcgatccacgggcaggcatccagaggatactgaccttcggacccatcgacttcgacaccatccacttcctgataagaagcgaactcaccagactcatcgtccagataaacatgggtgtagacctcgatctcttggtcaggcttgcgctcgccatcagcgccaagagagttgcgaacgtcctcagggagagccgcaaaggcgaccttatccacggtgacgatctgtaagacgttcccgaaggcatcacgctggaccacatggttgtggagcgtgtagagcttcatcgggttgtacgcagacgacgatgcgtctggtggtggcaggtagatcagagcggaccctgcaagggccaactgacggatcagctcaaagagcgtcacacggtacgagttggcttccatgtaggacatcaggattcgctcaaccatgcccaagccttgttccacgacagccagttgcgaagggtcggagaccagttgcttcgcttgccattcggacaccttgagcttcatccagctttgcagcgggaatagagccagcatgaccttggcagacaggttgttgagcccacgagcgcccactgcttgccacggagtggagtagtcagtagaggcgttgtcggagtctttagggaacagcgaggggatggtgaccttcgcgcagttttcagcacgggtctcgtagggaactcggtcgtttttcagccgttcgtaaacagcctttgcgccctcctcagcgagcccggtgcgagttgtagtcgccacgggtcacctccttggttagatgttgatgccagtaccagcggaacgagccacgctcagaccacgtttaccacgcgcacgggcagccttcttggcagcctcggtgtcagcatcatcggagccctcagtggtatccttcggggcctcaacgacagccgctgagacaggcgcaggggcagccacaggggtcggtgcggcaggggcctcgactacctgagcaggtgcatcgttaccgccagttgcttccttgataacgccagccgggtcagcgactttaacgacagccttggtgaccttcttgacgaccttcttaattttcttgcccatggatgttctccttcagttgtttgtaattgatctcgtagcgacccacgcctaagcgcttcgtgtacgccacggtcttgtagccagcattggaggccagcctaacgattgcccgaaggatcattcgacccacagggccacggtggtccgggtgaacccagtgccattgcgttccgaggcactcacctacatggtcatcctcatcgttgacgaccacagcgaaccccacgagcttcccttgcgggtctctcacggtgatctctatgcgttcgtcaagttcttcggttgaccggcagatacgctcgtagcattcgactctggacccgccccacgtcagctcagtgagttcctcaaggatgtcgctcagcacctcacggaagcaggccgggtgaccttccttctggacatgcgcagccaggttcacttagtgaccttcttgagagccttcttgatggatgcagcaggcttggacttcttgatggtcccggtgcccgtatcagcagcgacagcatcagacgaaccatcgccagtgtcctttgtggaaacatcggacttcttgaccttgagaccatcgagaccctcatcgctggaggtgtcatcgtcctcggttgagccgaagtccacgcctttaggttcctcaatgagaaccggctcaggcgctttcacagcatcagggttggtctttggggtcttgaccttggacttgaaacacatggtcattcctccttgtttagttgagcctcctgcatcagctccacgatctcagtcgccccatggcatccgtcaatgaagcccatgatgtactgctcggagaaccccgctttgcggagatcatcgacagcaccagtggagatcagataggaagcgttgagacggacgttgagatagtcggcagatgcgggagagatgtcagggatgtcatccgggttttggatgtagtgttggatctgcttgagcaataggactccttaagggaacactgggctccctctcgcaatagtgagggtaaattagggacgccagaggatgggcttcatggtctccatatcgaagtccgaagcgcggcagatgcgagccacttgggcttggaccaccagctcctcctcagtcattccctgcttggcagcgagcgacaccatgcagtcccagagggactcgccatcaggctcacgggaagtccagaacggaacctcctcgcctttacgtttgccggacttcatgaccttcacgtcttggaagtagaacttcggagactggagccaatccatcaggccaccatcgaactcgccaccgactcccggtacgccaccataaccatccgtggtgtcgcccttgagggtctgatagaagtggtgcaggtcagaggttgcctcatcgttcttgatgagttcctgctcggtcagccagaagaagtatcccggcaccgtgttgaagtccttgtcacagctcacgccgatcacacggtcacacttaacgatgctcgggtcagtcatcaggacgccacaaacatcgtcaccttcgacaccgtgccacttgagagacatgtcaccgtagtgcgccatgatctcatcgcagaacttgcggtagcccacaggcttacgcttgcccttacggttggccttataggtctcaaggacatccttacgccagttgtcgtcaccgctcaggatgcagatgtccacgaactcgtacttgtcctcagtgagcttgaacttgcgcttgagttgtgcggcgatgttcaccttgatggtcttgatggtgccgaacagaatgtcacgggctttcttgtgatcgcagaacagggtccatacgtcttcgccccagtcctgctcctcctcagcagcggacatcgctgagaagatgaggtagtccatatcatgggcgaggcccactttcagtttactcaaacggcacctccatattccgagagaaagtcttgaccggcagtcgtcaaggtccagagacccatgttcttaccggcagttgataggcacgagatgtggcctcgggatgaagcctcgttgaccagcgcaatgcgggaacgaacgaagtcgctttgatacgacctcgcttgctttttgatttcccagagaacctttaggtactcattcataccgtctcagtccaacgaggaccgggctcacggacaccagtgcgcttgttgtcgcagccagcgttagtgttacgctcggccatcacgcagttggtctcaatgcagccctgacaggaacgcttaggtggggcctcataggtcaccttgatgcagcccagtcgggcggtcgattcgttgccggtgatctcctcgaccagttccttacggatcagctcacggatgccagcacggtagatcagctccatcacttgctcagtggtacggtcgccacggaacagctcagcgcggaacttggtctcacccttgagcttggcgatctcctcagcggggatcttgcgggcctcctcacgggtttcgtcgaaggctttcagggtctcggtctttaccacgatggtcatcgggaaggacacgttcagtttcagagtcatgctcataaggatctccttagtgacactcgcgccacgttgggccgatcttggaatcggtagccagtgggcagcggaatttgaatgattcgcctaccagtcggatggcctcgttggagacctttgcgaccagctcagcgatttcttggttgcgacaggcgatctggagttcgtcgtgaacccacgccatgaagcagaagtcaccggggttgccatcgtcgtcgtaccagccatgaacaaggccatgctcctcgacgagaatgcgttccacctcgacgacccacttcttacacacaagcgcaccagcggactggagcagcgagttgagcgcagagtgtggggagcggacatggatctttcggccatcgagacctttgatccaacggcgcttccacttgatgtcgtacttcttggtgacgttgttgtacttctgctcggagatcagttgctcctcaagggctcccctcaggccggagatggccggggtgttctccatgaacgccttcttgagtgccttgccttccttcttgccaccaccaacgaacgacccaacgagaccatcaccagcgccatagaggaacgcataaatgaacgtcttcgcggtgtcccggtaggcgtcatgttcatggttctctttgtcacggattaggccaggaggagcgatgccagcagcgagcgcattgacccagtggatgtcaccgttcaacacggtctcggcatacgaaccttcgtcgaatggcgcaccgaagtgacccagacagcgcagctcaaggccagaggcgtcagtccctaactggacggcgttctcccagcccttcttgagcttcctcgcaaagaccgccccaaagagcgcacggcacgcaggtccgtacttcttcttggcgctgggcacttggcccatgttcgggtggctatgggtcgcacggcctgttacagccccgttggggttcactgagccatggatgcagccatcctcacggacgtatcgcagccacgctttgtcgccctcagagagcatcccaatgaccttggtgacctccatgaactcacgcacaaggttgatgcacgcttgcttcttagggtcagccacacggacgaactcaagggtctcatcgtccatcttggcagcgcccgtgttggtcagctcggtcggaacccagccagcatcacggaggactttctcaaggtgcgcccgagatccggggttgaacgtgaccagttcgattggcgtgtaagggcagccctcgaaggtctctcgggtgtccttcttgccgctcttgaggaacacgccaccgatcttgggatagaccaccttcggcatgacacggccatcagaccagtagtcgattggtgcaccagtcttcgggttgaggaactgcgacttaccacctttcggagaccaccacgacccgaaggtctggatgagttccacgaggagatcgctacgacgaccagccagctcacaatagagcttctcagctccctcgatgtcgaaggggaagccattgcgttccatctgggccagcgaccacgcagccgcatgttccaatcggatggcctcaatggcctcgccttgatcgttgaagtagtgcaggtcggagatgatcttgcggaacaacttcgaggtgacccgaacgtcctgctcacagtagtcctccatggactcggagcattccagccactccataccgtcaacgtagacgccaccatcgttctcaagctggaccttgaagtcgtgcttgtattcacccttcatctcgcccagacgatagccccacgcctcaagggagtgagagccaaacatcttgccggggaggatgcccgaacgcatgagacccgagtcacgatcaccaacgttggagtaaaccagacgggtcatcacgagggtgtccatcacgcgcttccttgggatgttcaaacgcttaccgaagtagagacgcttgagcttgtcgaggaccgggatgtcgtacttgatgaagttgtgcccaacgatcataccgtcaggcttggcagcttcggcctcaagggcagcgatgtactccttgaaggtggactcgttgtaccgaacatattgcccggtgaaatagtcctgaatggtggcgcagtggaaccgagtgacggactcatagagcccgttcgtttcgatgtcagagatgagcatgaggccctccttagttggagaaggcgacagcgctcaaaggcagccatacgacttctgggcgatacgggcgcacgttgaagtggaacagcacggcatagccggtgtactcctcggagcggtgatagcggatctcgatggcgcggaacaacttgccagcgaagtgaggaccaaaggcgaatgacgccagttggctattggccgggatcttggcgcactggacccggaagtccttgcccaccattggcgcaacgaggtgccagttcggaccccttgggtcgtccttaatgcgggccttgatgtcagcgtcaaccttctcagcgatcatcttgttgagcgcctcaaggattgggtccatcgggtttactggggcttcccaatgtgggtgatgcccagccttctcgatgtacgagtagcccagcttttcgagtacctcagcggcctgctcaccacgtttgatgaacttgcgaacgtcagaaccattcatttgtattccccccctgtagcgttgatgtgtgaactcactaaaaggcccctcaaagagaggcccttggatcagctcacgcgcttgatgtcttcgtgtttccacttagcttgcacacgttgatcgacggtggtttgcagggcgttttgagcagccgtgatggcagccttcaaggacgcttcacgagccaccagacgagcgtgacgcttctcttgaatgcggccagccagagtgatcaggaaagttacgaggtcgaagttcttcatggtttggttctcctttaaaagtcgggttcttgctggtctgcccatgcagcgtcagcttcgtcagttgcatcttggtcaggtcgccagccctcaggcttcgctaccaatcgaccagtccgcttgtcgtattccatgtagccagccacgcccgtctcgcccgtgaatcgacacttgaggagtcggaacaggatgaggttagggttggcaccttgttggtttcgctctacagcgatgatggtgtcgctcagttgacgcagaccaccggacccacgcaggtcggtagcggtgacaggtcggccttcctcgtgaggtttgcctttgtccgggttcttcaagtggcagataacgaagacgacaacgttcttggtcttggcgaagctcttgagcttggtcatgagccggtcgatcatcttgcgttcatcgttctcaccgtccatcgcagagaccacgattgagatgtggtccagtacgatcaccttgcagccgttgacttcgaccatgtacgccagtcgcgccaataggcgatcctcagcggactcagcgaaggcgtcatagaggtgcagcttgtcgctctcgaagatctcgtcgaacgccttgtcgaacatctcctcggtggtctcatcggggttctgacgaactcgtgaccccatgtggagccctacgatgtcctgtacggtttcctcaacggcctcctccagcatcgccacgcctacgggaatcccgcagtcattgaacaggttgtaagtgttctgacgaacgaaggtggacttgcctgagccggacccagaggtgaccagaacgacctcgccttcgcggatgtccttggtcatcttgcggagttcgtaaggagccacgagcggataactcgggactgctttcttctccttgatgcgggccttgagggacttcgcagagaccactccatccggtacgaatggggcagcgttccacatggcgtccatcacagctttggcctgggagttctggagacactcgttcgggtctttgaaaggcaggactgcgatcttgaccttgcccggtgggagaacctcagcggcttcccttgaggcaatccgtccgggctcatccatgtcaaacatgaggatgatctcgtcgaactgatcgaagtaggcgtagttggccgcacaggtcgccttggcagccttcgagccatgcccaatggacacgaccggatacttaccaccttggatctgggccaccgtcaggcagtcgatctcaccctcggtgacgacgatcttgcgaccaccgttccacaggtgccgaccaaacagagcgtccttgtcgtgcttgcccttggtgaagaagtccttgttggcttgacggcacttctgcgacttgaggttgccctcggtgtcgtagtagttggctatctgtaccgggacttccttgccctcgtgaggcgagaacgccttgccgatccagtaaccatagaggcggcagattggctcctgtaggaacctcttagggagcgccgagaagtagcctccagcctcgcccatcgagagcgtgccatcagctttgagcctcggtgtgaactccccacgctccttcccatcgggtgccttataggcagtctcagggggacacgcaaagcagtattggtgaccatcagagaacagcgagtttgcgtccgacgacccacattcctcacacgggatatgcgcaaggaaaacgctttcttcgcgttcctcatgcgacgacatcggccacctcgatctcatcgacgtaacgtccatcacgcattggtgccttgtggatcaggtccagccacttggcttccatcttttcagcacgggagccacgagcgtcctctcgcagttgaaccagattggtccaagcgtgagcgcccatgaagcgaatggttgccccttcgatgcccctttggatgcccgagatggcgaactgattgaggttgtagtcgaacttctggatggcctcggtgacacactcgacctcgtaaagaatcacgtcgatctcgcagccttcgattttccagacaccttgcagccgatcagagtcggagccggtgtggtacttggggaacttgtggtaggtgtaaccaccttcatcgagcgctctggaaacagtctccgggtcggtgcccgcgcaaatgatgtcgatgtctttaggctcaaccgagaagaacaggtcacgggcacagccaccagcgataatcgcgccgatgccacggtcaatgagatgctcacaaaggtcgaacccaccttgcagtaaggaacgattcataatgacctcctaaagtcaacgtttaaaaacaacaaagccccaccaaccgaagtcagtgaggccgtgtcgcaacagtgagggtttattaaatcccttgagttttcagccactcggccacgtcgaaggacgggcaggctttacccgagtcgaggtcgcggtgacccacgatcttggcttgcggataggtgcgcttgtgagcgatcagcagcagcttgagcgagttgaattgctcaggcgtgaagttgttctctggggcgcccttggcgttgatcccaccaacgaggcagatgcccagcgaggtggagttgtagcccttggcgtgtgacccaatgacgtcatgagggcgaccatcctcgacagtgccgttacggcgaatgacgaagtgatagccaacgtccagccagccttgttgaacatgccactggcggatctctcgaacgccgatgtccatggtcggtttggttgccgcgcaatggaccacgagcagggtcgtacttgggcgtttcttgaaagcagcctttggcatcatttacctcctttcggatggagtatccccgctgggatctccttacgtttctcctgtagccatgctttaggaatgagtttgtctgcgaacatgatcccgtgcttcgtgcagaagtcggcgtagctcgttggggagcccttatagatcttgctcttggagttcgagaagaccagacggatgtcaaggtcagggtattgctcacggatcagcagatgctttttccggtcgtccacttcccatatccctttggtctccacgatgatcccgttacgcagaacgaagtcaggtgtgtacttggcctcacgggccggaacgacgtacttaatgtggtactgctcgaagtcgaaagggactccgagcttgtccatgtgagccgcgttgcggtcctcaaggccggatcgaaaagcgcctgtacgagcgcccttcgggccagcgtagccagccatcagaagtccgaggcagcgtcaggaatgacctcgccagcatggccttggtcttcgtgatcgtcccagctttcttcacgctctggagcgacgtagccttcttcggtttcgtcagcccagtcgtcattgccagcagcgtactcgaccagtttgatcagcatcacgctatccagttgcagcttgaccgaggcaccgacaacggcaccgaaggtgtaggcgaacatggagaagcgaaccttcaactcggaaccaccagagatcgcaggaacagcgtcgatgcgcttgcccttggcgtccacgaccttcaaggtcagcggcttggtctctttggtttccttgtcttggtacgaggcgtagctggagaacttgaacgtcacggtgccatcgtcgttctcgaagaacggcaggtcgccctcatagggttccagcagtttcttgccacgggccagcttggcggtcagcgatgcgcggttcttctcgaagtcctcgcagattgccgcgtagctttgttcttgcatccgaacgatgcggtcgatgattggctgggcatcagcacggctcacggtcaggttgaccttatagacgccacgagggttgccgaagcctttctctgggttgccgtagtccggcttttggatcgagcagtaaggttcagctacgcctttcggagtaaagaagaactgcttggtggattttgccatcgggattatctcctatgaaagtgggaaggtaggtgtctcgcaacagtgagggtttattcagtacgagagggattcacgctcggtgaacagggtctgcttgaaggtctcaatgaccgggatcagcgtcaccttggtcatcgcatggacgacctcacggaagttgttcttgaggaactccttggagaaccgccagcagccgtgtttgaagtggtgcagctccttgccttccagctcagcggtcacgatggcgcgctcaatgagcagcccttcgaccaactgacgttgatgggcgtcaaggatgtggatgtagaccacgccagccatccccgcgtgcttggtcacggtgaagttctggatgtggaggaagccatcaggcatcgagcgggtgttgccttgggccaggttcattgagtgacctccgggcgaatgcgccgaacgttgtcttcaccgtactcaaggtcagcagcttcgagcgcttcctcaatggtgcggccatacattggcacctcttggacctccttgcggtactccacggtgacgaggaacttcttcattttctggtcttgcttaggcatgagtaattactccttgagttctgagttggtcgatcatctccgaggcgtggccccacttgttcaccacaacggcgtccatttggaagtcacgcagttcaatgtcagtagcgtgtagcggctggtcatccacagcagggatcgcccagtctcgggagagacgaacgaggtgcgcttggcggatgctcagtgctgcatattcgttggcttgacgcatgtcagtgacgaccacgagggcatccttgggagccttcttgatctccttgagaccctccagcagccacacgtccgggttctgcttatagttgcgacggaagccggtgccgtattgctggaggtgccagcgaggtgtccttgggatctcgatgtcgaggatctggggctcatttagcagccaatccttgtactcgctctcagggatcgcctcgattgccaactcctcgaactgagcgtccttgaagtcggtgtgcatgtggctctccataacgatgcgttggcattcgtcgagggccagcatgtggctgcattgcttcttgaggacatccccaaaggcgacccggtagacccggtagccctcgatcatcagaagctcgcacagggtgtctttgccgctacgaccacgctcagaagtcagggcgatgatgtcagtcattgacgatctccttgatcttggtccagaggttcttgaagaacgtcttggtgcgctgccagaagtcggcctttggcgctggtggtttaggtggacggatgttgaaccgggcgcagttgcgttgacggtcgatgttcgattggtgcagacggtaggcgaacgaacggtctttaacgggcatcgtttggatctcctttcggtggttggttgggtgtctcgcaacagtgagggtttattaatccgcgtcgtcgtagaggcgctccatgggagtccggtcaggctcgaagccagctataaggatggcgaaggtgatcacaacgaaaactatcatgaggaacttgatcatagatttctcctattcagacaggcacaaaaaagccccaccgaccgaagtcgatgaggctcgtttagttactctttgatgagtggatcgctgataccacggaactcgtcgaagctcgggtgacgcatcgacccatcagggtagcgttccatgcaggtcactcggaccatgtggtggtggtacgggttctcagcgtcaaccaatgagctgcccatcccgtagatgatcgactcgatgtcctcaacgtcataaccgttgtggtccatcactttcttggtgaactcctccatctgggccttactgatcttgcaagcgttgaccacatggccggactcaagttgaacctcgaagccgatcaccttgccctcgttggctttacccttcgagccccagaccagaccaaccaccttgccgtcctcgttgttgctcggcaccttcttccaccagccgttgcacttcgagcggcgatagaagcccatcggatctttgaccaccagaccctcctccttacgctcgcgcaccgaggtatagagctggaccagcgagagtggcggttggagctttacggtgatctcgttgccttcctcgtcgaagccttcacgctcaaccactggcatggtctccactgagaagacctcgtaggactcagcgacgatccattggatctctgggaagtattccttgagcttggctacctgatactcaacatggatcttacggacgcactggaagacctcgtattcctcaccgctcagcacaacgtccattggtacgatgtcgaagacgtagacccggatgcggctcagcgggatcgactcctctttacggcgcagggtgcccgaggtggtcttgcagggaacctcacggtcatccatgtcggtcaggaccaactcagcgtccaacatgaacccttgagggaacatcccctcgcctttgttctcgttgaagaagtcagcccagcgagggtcggtgtccagaggaccatgagatggcccgaaggccgggaagcgcttgccctcacgggacaaccactcgacttcccaaccgtggtcatgcttggtctcgatcaggttcacgcacaggttcaaacgaacgccgtccttcttgacatcagcgatcaggtaggactcatccagaacagcctcgacagccttctcgttgtagtcggttgggcggaatggcttggtgttcaggataacggcttcgactttggacatggggttccccttagttggattcggtagtggtggttttaggcttgcgaggagcgcgggttttcttcaccggctcagtcacaggttcagcctgggcctcatcgacgatcatcacgtcagccttgacgccttgcagttggctcgaagggaccgcgctcacgtcagtcacctcagcgggcttcttaaggatgttcatcagggtcttaaagtgcgcctcaacggagcggatggtcacagcctcggcaccgacccgaagggcttcgatgcgagtctcaaggtcaccactgagaaagcggttgtccatcagctcttgaacgtcatagccagtcttggcggtggtcgtaacgtcaccgatggtggtggaggtttcgatcaggatcaggtcgtcaactttggacgaagtggcggtaacgataacttgcattgggatctcctaaggttgggaattagtaggcagcgttgccggtgcagattggggtccactctacgcgaccaccacggacgggcttgttgcgcttgcccttcttggtgcggatggcttccatctcggagtcatcacgcatggtacgtttggtggtcttaacgaagttctgagcggcgttcataattggtttccttatgcgaaggcgaagtcggatttgaggatgtcgcggatgttgagcgttcccatctttggaagctcaggcatcttgtccagttggctctcgtgtagttgctccatgaattgctcacggaagtcagccagcacgttgttgttctcgtaggtttcgaccatggtctctcggactgcccggaacatcgcgccagctttggcagggatggtgccgaacgagtcgtggatcagggcgaagaatcgaatcccgtggttgtcgtaaccgtgtacgactgtcttgcgaaggtgcgagccgtcttggctgtgaacaaagttcggagagatacccgactcttgcttccttgcgttgatcttgctggacccgttgtcgcgcatcatcacggtggcttggatgcgaacgtccccgaggaacatgaggtcgattcggcgcgttgggttgatcgtatattgctgccataccgggaacccatcaggggtcgtccagtagactggcatggcaggcttgaggatctctttggtcttcttgcacttgacctcagaggccagcagcttggcggccttctgtagccagttcattgcttccacagcggcgaccacaacaacactcaccgagtcccagattttgccagccatgtatcggctcgcttcaccggggcttgtgaacatgtggccctcatcgttgtcgatggccttctttacgatgtcctctcggacttgatcagcgaacccgtaggctttcgacccgtaggccagcgtcattacagaccgcttggtgaccttacgagacatcccgtaagtgagccacgcaatggcgagggtcttagtgccgagacgtttaacatcgcggatctctccagtgacctcatcgacgagagtttcgatccagtcgtccgtcccgtacttgaggtcatattgcagagcgatctcgacttcatcagagacgatcttgtagatgtcttgaacggagtccgaagggatgaggttgacagcacgcccgccacgttcatctcgaagcatcgcggaaaagtgctggatgccagaacaggaaccatcgaacgcaaggggtagggcactgacgtgtgcagcgccattagctttaacgccagcccactcaaagcagaaagcgaggaagcagaatggggagtccatggacatccattcggtgacgttgaggggatcgttggcaatcgccaagataagttcttcatggtctcggacccattgtttacgttcaggaaagggcaccttatcgacgcccgcagtgttggccccgtgaatcatgagccactcgattccttcctcacctacaggttccccatgggcagcctgcaagatccctttggtcatgtcgttagactgagggttgaaggcagggaccgcgtagacccggccacgccaatcgaggttgtacgggaagtagatcgcatcgtactcagcaaacttgttggcttgctccagtccgaactcgtaggccaatcgacgggacacccttgcggcgtccttacggtagaccccagcggcctccttcttccacgccttgagagcgtctgggttggtgtcgatgtcgtggggttttagtggcagctcttggcgttccgttgtggggaactccttgatctgtacgttcttccactccatcaccgcattggcgacctcaaggacgcgcttattgactgcccaagcggttgactgtgcgatgttgactgcccggtaaaccgcaggcatctcgacatcccggtagcgctctcgggcttgcttgccgttgagtcggatgaaggtcagaggcttgcgacccttggcccagtaaccgccaccttgcagacccttccacggtttaggcggaacgatgcagggttggtactgaggcgtgataccggccagtgcgaaggcccggttctggatcttgtcagcccattcatccttgaggaacacatactcgccatcgttcttcttgtccccagcgtgatcacggcgaacctcgatcagttgggtcgattcgatcaacagctccagcattcggatgcccatgtggaagcggacatctgagtcagcgacgttccagtcaacccatggttgggccagttcgcccttctgtagcatcgactcctcgacccgctccatgtacgccttcttgtaggtcataccgttgcgcttggcgagagccggggcgatggctcgcttgaagtgttcggcctcaaggactcggatgcggccaaagcgcgcttcgtcttcgagggctccaccgaccacgatgctcatctcggtcaccgttggggcaccattacggcgctgggcgatcatgttgagaacgtagcggatggtcacagcggccatcgtgtccgggttcatttgctgtgcagcggcgaagctcacatgtttacgaccacgacccttgttggcttggtggtcgatccatgcggtgatcgcagcggacatcttagggaccagagtgcccagcagcggctgagcggcgatgttgttggagaactcaccgcgctccatctggcgctccatctggcgatgaaagcgttcctctccaagcgtgtacgcttcgtgttccaagcgcagttgctcagcggccagttcggggccgtagatgctggagagttgattgaaggcgaatgaggatgttgcgatgtcagcgaagtcgtgacgctcggggatcattctttaagatgctctatgagatatagttgtcttatagaattgctctataaggtttatctcagagggatctttaagatgtctttaaggtgatcttttaggcaggaaccctctgaggtgtctcgcaacagtgagggtttattaatccagccttacttaaccacctcgatccggccatgaacgtcggccatcttgtagacaaatgtcttgagttcgaggtcatcgttccacttcgtgatagcggagtaatacttgctgatctggtctcgcagttcggccacttcggagtcctcaaggagaccctcaggcttgaccgcatcaccatgggtggtctcaatgacatcgacccattcctctttgcgccaccagagcatcccggtgactcgcagctcttgccgcttgagggtcacagcaggccggtaggtgcgctctaagcgctggtgccgctccagcttccacttggcatcgcattgaggctcatggagcagctcagggcttcgtgaccactgcttgatcgtcagtaggtcatcagtgatggcaactcccaggctgacaacgtgacgaccacaaggcccaaggcccagctcaaaggtcagctctttggccttgacgagcccgtaggtgttcggatcgacccacgaggcgcggaacttgatgagtttggcgcgctgtgtgtagtcgcacggtggcagtggcagcatggacgggcgtttcgggaagccacgcatctcagaagcctccccgatagcagcgagtgaagtcgccttgatcgctgtagcgcaggccggggcacaacataccgcccaccacttggcgagcttccatggcgctcaggaacgcctcagtgaagtccttacggcgtccgtaccagtagccaaaggcgtccttcccggtgcgaacggtgttcttcgcggtgatgatttgttggtcaatgagccccggctttcgaggctggtaattcgtgtgcatcacttaacttcactccagtgaaccagtagttgtcggcaaccctcggtgacaggcaggccgtagtgcagggtcgttttacccttgaagaacatgccccagccgggttcgttctgagggaccatcacgtcagggaagaaaggcccttgagcagccatcgtgccgccccctacatggtcatcgttgagcgccaccaccagagtgacgtcagagtcccggtcggtgtgccagtggcctcgtggagtctctgagggctcatagcgggcagcctgtacgctggtcaggttctcaggctcaaggttgaacagcaccttggcgtaggcgatcccagcgtcagcccagaaggaccggaagacctcgaacagcaccttgtgttcatcctgcaaggtcacctcagggatctgcgcctcaaggggctcctcaaggttgggctcgaagacgaacttgctcatctcgtgcttgatgtcgcggcagtagcccggatgcaggtaggcgaccgagtagatccccggtgcatggcagaccacgcaatcgtcaaggaacttttgccaactgctcgtgtcagagaacttgcttgggttgatcccgccgttgtcctcagcgtatgcggccatctccttgagggtctcaagatgctcacgcagcaggggatggtacttgtcaaccgatgcgatgcccgtggtggccttagtgagaacggtactcatccgaacactcccagtgcgacgagtccatgcccagcaccaccaccaaccgcaagcgcagtcaagtacccaagggtctctttaaatgctgatttccaacgattttttgcaggtttgggcttgatttcagcttccagttctgcatcacgacgacgagcggtcaacaaaggatgctcggaacgtgtgtataattcgctcaacaaccccgagaaggctcgctcatgctcctcggaccagacgaagcaggcttgcaagatcaggctgccaacgtcttgaccagaaccagcaaggaactggaaggtgtagcccccgaagtcgtcgggttttacgtccacacggagccagcgttgcccgtgccggttctccacatagtgggcgtaaccatcagagagagcgccacgcatagcagcgatgagacgttcagcaaatgcagccgaggtgaagttagtacggttgtagcgttgcataattcaaagacctaagaagtgcggtaaatggagcggtacagaatgcccacctttgcgctgttatcgacgcgaaggcaggctcttattgaccatcgtagagaggtacttatttgcccggtggcaacatgccctcgattggcttgcccgattgttgctgaatcagcaggtccagcttgaggcgttccagtgcagcggcctcgtcgcgttgcttctgctcgtcttcaaggcgttgcttttcggccttctcctcgttgctggagttgttccaccagttcgccagagaggtgcccgcaaaggagcccgctacggtactcatgaagccaccagagccaccgcccatggccgctggagccgattgatggaccacagtggtacggttgacggtgacgttctggacgacccgaggagctggtttgtaggagctggtacgcggtgcgctgtaagagcgggatgagctggagctactcgaccgactacccgagaaacctcgtgcctcagcgtcattcgcatggatggccccgagggcgatcacggtagcgaacagagcgaacaggcagatgtttttggactggcgagcgattgcgtggatcatttggatctcctatgtggtttgcgttgagttgttcccaatgagccctcagcgaaggcccatcagtgaatcactcggcgtctatggtggcttcgtcgaaccatctggagaacatggactcgaacgatgtgatggcgctgtagtcggctatgacctcctcagcggagttcccatagaccagccagaacttgccgatgcgttggtaggtgccgtcatcaaggcgaacccggtagaccaccacatggtcctcatcagtagccatgcaggcgtcaatgccaacttgcacggtgtaggtgtggttggtctcgaagtcctcgccgttgttgatgcggaagcagtagccagagccagtgatcgcagtgagcagcttacggaggactcggcgttccccaatgatgcgctcagcggtggccggatacttggccttgatttgctcgttggtcattttcattgcacttgctccagacgggagaggaagacgtagaactgacgacccggtgacagcgaggctgtagcggatggcttgtagcgcatcgcttgagcccactcatagagcgtgttggattgactggaggagagcgtgtgaggatcttgcccgaacttgatgccctccttcttgagttcctcaatgatcacccggtagagcatctggcggaaggtaggaacgctcatttcaggtactccccggactcaatgagcatccgagcggcttccttggtgatgcaggtgttctcactcggtgaccaatacatggtgcccttagggacatcgctgtaggcacactcggtgacggtgcgaccaaccatctgcttgatgtcgcattggtcccactggtgcagccttgaggactcattgaggtaatggtcaccaccgttgaggtaggcattgcccatgagtgcccattgcgacttgctaaagtgagccttgacgacacggagaacagcaggtgtgacgaactgagcgtagtagcgacgatgagccgcgctgccatcctgctcagggtattccgtggaggtcttgcgaccatccatgtaccaatagcgggtcaggtagaccttatcgttgatcattacgatgtcagcggtgtgttgcttagccatggtgattgctcccaggttgttggtgtgacgttgagttgttcccatagagccctcaaggaaggccctacagtgaatcgctcagacaccttcgatgatgatggtgatatgctcaccgttgtacacgatgaacaagcggtgaacttggtagtgaacccgacgccagcgaccctcatagaaggcaagccagcgatcaccatgttcattcttgatgctcaccttctcggtgcggaatggtcccggtgccttgccatgttggaggtagccagtgtccatggtgttactccttgtcagcgttgagttgttcgagcaggtcagccttagtacggtgccacacggcctcaaggacacggcagcgagtcagcgttgagtcaacctcattgcgcagcttctcccacataggatgagcagcagatccctcaaagcgcccaaagatggccttagcggcttgatgctcagcctcagccttcacaatacgtgcatcgaggtcagccagctcagtgcgtatacgatcagtgcgtgtactcatggtgatgctccttgcttgtgtgttaagagatacagacgaaggctctccacgtcccgtgctaatgcttagatacacgagagccctcttgctgtatttcctttcactgctacgcaccgagggtctgagcaagcccgttaagacgtcatcccgtctcagtgcgtagtgttgcagtccgagttgttaaagagcgtaagggtgcccgttaggccgtagttatcggccaattcgttgcccttcttgcgacacatgctggtgactttgacctcacccgacccaccctactcatgacatctgctcaggtagctcgttgcgtgtttcgttgttgatgtggcgtattctacagcgtgttgcggtgttgtcaagcgtttgtttctgcccttgtgtcgctcatcgttcgtcacccttaagacccttggcacacgtatgatcgcaggtcagatgctactaagctaagcgaccaactcagagacacccgttaggccgtgtctcgttgttgatgtggcccattgtatagaactgggcatcgccgtcaacctgtttattcatccagtgtataggtcagcctgtaacaactcataggctacgcatcgcctctatataggcaactcaaggccatcctaaggagcagggtctacaggcaccttataggagccctaaggatggccctaaggagaggcgtcacatgatcaccctgggagtgacctaaggagcagcctaaggatggtcctaaggatgctgatacagatagggacagacggactactgtatgaatccacagggttgacatcacgctccctaaggtccatcctaaggccacctcaacgggatctcaaaggagcccaccatgcgatagcctaacgatgtacctaacgtatccctcagatgatcattgagatgccctatggggagcagagcccttgggatggctgagagaggccctatggggggattcgtgggcgtttgtctatgagaggtgccctttcagattttctatcagattcttaaaggacatcctaaggtatccaatgggttcatgcaagtgccatctatcggttatcctaaggaagaccctaagggcctatgaggactcctaagggctttcttaagctgaccaatgaggtagggtgtaaccataccgaaattggtcgtgtcggtcactctacgcagccaccagatgccacacatataaggccagagaccatgttcatgacatcactgccattgaggacacctaaggccaccagcagggtgccgatgagcttgtaggtggtcttggagagagccaaccgcttgagtacgagcagcacggtggctttctctacgtccatggtttgacctccttcttgataatgatcatagttgataaccatccttggtccagttcctttggtcggacctcatcctgaggaacccaaaggttagaggcaccaccttaagaaccttgctgagatcttgttaggaatctcttaggtatcttagggtgggcctctcccaatagtgagggtaaataaacttcgtcgatcatgcttcgatcatgcagacatcctaccagcccatatagttggtcattgagccttcatcgtcgaacatgatgtccacggagtcactgattgcgatccttctgacgtcctcaaagcccatcagttggttctccatctgggcctccaagaactcagccatcagttccgactcgcccagcttggaatccttctccatggcctcagtgaagaactggacgccaatcgcaagggcatccaagcggtcatcatgggccagcgatccacgctcacgggtgatccgagagagctgatagagcaggctgtacttgatgtccgtggtcccgtcagcgttgagcgcagtccggtagtccttgtcgatgagggcctcgctgagaaccagcttatggctgcccagtacgggctccagaacgtcgcagatgcggagttccttctgacccttggacttgacctcagtgatcgcgcacggccatgtagcggtcagcacaggactgatcagcttgaggtacataccgtcaccgaagttgccctcgatcacgacctcattgaccttgtagatcttggcgaggttcgagagggcttggagggttgtgtcctcgtagccaccacggaagccaccagcgtccatcaggaagatgtaaccgttcaactggtacagcactgcatagccagtctcatccttaccgcgccccgatgggtcgatcacaaggattttctgagcgtactgcgcagtggcctgacctacagcttcgtagcggtggaagcggtcacctttgagacccaccagaggaacgcctttgacctcgttgttggcgtttggcatccatgtcagggtggttggccccttcatcatgtcgaacgtccctacgatgaaatcacgcagcttgagcgggtacttctcggcgtcactgaggttagggttgagcatgaactggagggcgaagccacctttcccataggagagttcacgttccctgagatctgtatcgtcgaagcgtacagggtcagtcggtgcccagaacagggaaccatcagctcgcagctcagcctccagcataggagccagccgtgggccataggagtcccaatccttctgatccttagggtatctcgcaggccagatggtagtgacgtagccacggccttccagctcacgatagagggtcatctcggtctgaggggtgcccagatagatgatcgtaccgcccggtttcaggatcgcatcgaactccttcacaagttctcccagggcgtcacgcgcagactgggtgcccgagttgttcggaacctcaacgtcatccgcaatgaggatgtccgcacgggaacctgtgagctggcctgtgatacctaccgacttcaccgagggcgagtggtcaggcttggcgagacccacgtcgaaggccagagcggagtctcgttgacccgtccgtggtttcagctcgtggaggaatggaagcagctcgatgatccgcttgatgaagatggagttggcgtctgcccgttccttggaagcggacacgatcatgaacttgaggtccgggttgccccacagcttccacacaacgaatgcgcaggtgatgaaggacttgccgatacctcggaatgcttgaaggataaatcgacgttcgtcgccagagctgagcttcttggacatgtcgatctgacacttggttggtttgggtaggttgagggctctccacaggacaaaaagaaaggccacgaatgaccttttcattaacgctatgtcgtcgcccccattacggggtgcgctcatttagttcctccttggatggtcttaatggaatcttgcaggcccttcacttgggcgtctgctcgttgggcttgttcgataagaaatcgaccatcgctttctcgtagctcggcgcgaccatcagcgaggggtctaccgtcagccgtgacgcacttgacggtggcatctgcgagggcgactgacaggctgataccattgctacgcagaccagcaatagtccgatcagcagatgccttactcgttgagagataggcttgccagttcttcgagacatcagcgagggctctttgggttgtttcacgttccacctccagttgacgggcagccgccagttgttcagtttgatgtttgagggtcagagtgtcggttgcgtcagagtgacctttggcatacgtcagacctaagcctgtgcaaaccaaaaggccccacatgacgaactctttaaggttcaacatgtagggcctcctttagtggcgaacgtccgaggcgtacagctcgtcgtcagttaactcagggatctcatcgagagccgaagcgagatcgcccagaagggactcatccggttgcagcttggcgatggtgaacttgtgtcgttccagcagcttgcccacagcgttgtagagctgaggcgttctacgctcaggatcgcggaggtcagccaacatgttcttcgccatgtcagtgtccagcgcgaccagcaggcgcatcagtaagtcatcactcatttctcagcctccttgtcttttcggcgttcttctttaacggtcttgtaaaccacgattacagtcatcacgagggagtacaaaacggcggatgcgtagaaccactcacttggtgaaaggcccagaaacaaccgggccgtcacgtcagttacagcagcacctactactggagtggcttgcaccaccccgttgttgaagtcgatagagatgcccattaggacacctcacggttgacgtagcagaacgtcatgtcataggtcgctttgtggtacgactcgatgtccttgatgcggccatagaggtacttggcgcgctctacacgctcaggtgcagcgaggcccaattggacctcagggat

SEQ ID NO: 2 - DNA, 41402 bp, unidentified
  misc_feature 1..11: note = bacteriophages nucleic acid sequence
  source 1..41402: mol_type = genomic DNA
ccaagtgagtggttctacgcatccgccgttttgtactccctcgtgatgactgtaatcgtggtttacaagaccgttaaagaagaacgccgaaaagacaaggaggctgagaaatgagtgatgacttactgatgcgcctgctggtcgcgctggacactgacatggcgaagaacatgttggctgacctccgcgatcctgagcgtagaacgcctcagctctacaacgctgtgggcaagctgctggaacgacacaagttcaccatcgccaagctgcaaccggatgagtcccttctgggcgatctcgcttcggctctcgatgagatccctgagttaactgacgacgagctgtacgcctcggacgttcgccactaaaggaggccctacatgttgaaccttaaagagttcgtcatgtggggccttttggtttgcacaggcttaggtctgacgtatgccaaaggtcactctgacgcaaccgacactctgaccctcaaacatcaaactgaacaactggcggctgcccgtcaactggaggtggaacgtgaaacaacccaaagagccctcgctgatgtctcgaagaactggcaagcctatctctcaacgagtaaggcatctgctgatcggactattgctggtctgcgtagcaatggtatcagcctgtcagtcgccctcgcagatgccaccgtcaagtgcgtcacggctgacggtagacccctcgctgatggtcgcgccgagctacgagaaagcgatggtcgatttcttatcgaacaagcccaacgagcagacgcccaagtgaagggcctgcaagattccattaagaccatccaaggaggaactaaatgagcgcaccccgtaattggggcgacgacatagcgttaatgaaaaggtcattcgtggcctttctttttgtcctgtggagagccctcaacctacccaaaccaaccaagtgtcagatcgacatgtccaagaagctcagctctggcgacgaacgtcgatttatccttcaagcattccgaggtatcggcaagtccttcatcacctgcgcattcgttgtgtggaagctgtggggcaacccggacctcaagttcatgatcgtgtccgcttccaaggaacgggcagacgccaactccatcttcatcaagcggatcatcgagctgcttccattcctccacgagctgaaaccacggacgggtcaacgagactccgctctggccttcgacgtgggtctcgccaagcctgaccactcgccctcggtgaagtcggtaggtatcacaggccagctcacaggttcccgtgcggacatcctcattgcggatgacgttgaggttccgaacaactcgggcacccagtctgcgcgtgacgccctgggagaacttgtgaaggagttcgatgcgatcctgaaaccgggcggtacgatcatctatctgggcacccctcagaccgagatgaccctctatcgtgagctggaaggccgtggctacgtcactaccatctggcctgcgagataccctaaggatcagaaggattgggactcctatggcccacggctggctcctatgctggaggctgagctgcgagctgatggttccctgttctgggcaccgactgaccctgtacgcttcgacgatacagatctcagggaacgtgaactctcctatgggaaaggtggcttcgccctccagttcatgctcaaccctaacctcagtgacgccgagaagtacccgctcaagctgcgtgatttcatcgtagggacgttcgacatgatgaaggggccaaccaccctgacatggatgccaaacgccaacaacgaggtcaaaggcgttcctctggtgggtctcaaaggtgaccgcttccaccgctacgaagctgtaggtcaggccactgcgcagtacgctcagaaaatccttgtgatcgacccatcggggcgcggtaaggatgagactggctatgcagtgctgtaccagttgaacggttacatcttcctgatggacgctggtggcttccgtggtggctacgaggacacaaccctccaagccctctcgaacctcgccaagatctacaaggtcaatgaggtcgtgatcgagggcaacttcggtgacggtatgtacctcaagctgatcagtcctgtgctgaccgctacatggccgtgcgcgatcactgaggtcaagtccaagggtcagaaggaactccgcatctgcgacgttctggagcccgtactgggcagccataagctggttctcagcgaggccctcatcgacaaggactaccggactgcgctcaacgctgacgggaccacggacatcaagtacagcctgctctatcagctctctcggatcacccgtgagcgtggatcgctggcccatgatgaccgcttggatgcccttgcgattggcgtccagttcttcactgaggccatggagaaggattccaagctgggcgagtcggaactgatggctgagttcttggaggcccagatggagaaccaactgatgggctttgaggacgtcagaaggatcgcaatcagtgactccgtggacatcatgttcgacgatgaaggctcaatgaccaactatatgggctggtaggatgtctgcatgatcgaagcatgatcgacgaagtttatttaccctcactattgggagaggcccaccctaagatacctaagagattcctaacaagatctcagcaaggttcttaaggtggtgcctctaacctttgggttcctcaggatgaggtccgaccaaaggaactggaccaaggatggttatcaactatgatcattatcaagaaggaggtcaaaccatggacgtagagaaagccaccgtgctgctcgtactcaagcggttggctctctccaagaccacctacaagctcatcggcaccctgctggtggccttaggtgtcctcaatggcagtgatgtcatgaacatggtctctggccttatatgtgtggcatctggtggctgcgtagagtgaccgacacgaccaatttcggtatggttacaccctacctcattggtcagcttaagaaagcccttaggagtcctcataggcccttagggtcttccttaggataaccgatagatggcacttgcatgaacccattggataccttaggatgtcctttaagaatctgatagaaaaatctgaaagggcacctctcatagacaaacgcccacgaatccccccatagggcctctctcagccatcccaagggctctgctccccatagggcatctcaatgatcatctgagggatacgttaggtacatcgttaggctatcgcatggtgggctcctttgagatcccgttgaggtagcgttaggatggaccttagggagcgtgatgtcaaccctgtgtatccatacagtagtccatctgtccctatctgtatcagcaatccttagggccatccttaggctgctccttaggtaactcccagggtgatcatgtgacgcctctctataggaccatccttagggctcctatgaggtgcctgtagaccctgctccttaggattcgatcagttgcctatatagagggctcaaggctcctatgcgttgttacaggctgacctatacactggatgaataaacaggttgacggtgatgctcagttctatacaatgggccacatcaacaacgagacacggcctaacgggtgtctctgagttggtcgcttagcttagtagcatctgacctgcgatcatacgtgtgccaagggtcttaagggtgacgaacgatgagcgacacaagggcagaaacaaacgcttgacaacatcgcaacacgctgtagaatacgcaacatcaacaacgaaacacgcaacgagctacctgagcagatgtcatgagtagggtgggtcgggtgaggtcaaagtcaccagcatgggtcgcaagaagggcaacgaattggccgataactacggcctaacgggcacccttacgctctttaaaaacttggactgcaacactacgcactgagacgggatgacgtcttaacgggcttgctcagaccctcggtgcgtagcagtgaaaggaaatacagcaagagggctctcgtgtatctaagcattagcacgggacgtggagagccttcgtctgtatctcttaacacacaagcaaggagcatcaccatgagtacacgcactgatcgtctacgcactgagctggctgacctcgatgcacgcattgtgcaagctgagaacgaccatcgagccgctaaggttctctttgggcgctttgagggctctgctgctcatcctatgtgggagaagctgcgcaatgaggttgactcaacgctgactcgctgccgtgtccttgaggccgtgtggcatcgcactaaggctgacctgctcgaacaactcaacgctgacaaggagtaacaccatggacactggctaccttcaacatggcaaggcaccgggaccattccgcaccgagaaggtgagcatcaagaatgaacacggtgatcgctggcttgccttctatgagggtcgctggcgtcgggttcactaccaagttcaccgcttgttcatcgtgtacaacggtgagcatatcaccatcaccatcgaaggtgtctgagcgattcactgtagggccttccttgagggctctatgggaacaactcaacgtcacaccaacaacctgggagcaatcaccatggcactgactcaactcaaaactgacaccaccgagatcgctggcaagacctacctgacccgtcattggtacatggatggtcgcaaggttccgggctctgagcatcacgagatggacggctccgctgctcatcgcacctactacgctcagttcgtcacaccggctgttctccgtgtcgtcaaggcccactttagcaagtcgcaatgggcactcatgggcaatgcctacctcaatggtggtgaccactacctcaatgagtcctcaaggctgcaccagtgggaccaatgcgacatccgccagatggtgggccgtaccgtcactgagtgctcctacagcgatgctcctaagggcgtcatgtactggtcgccaagtgagaacacctgcatcaccaaggaagccgctcggatgctcatcgagtccggggagtacctgaaatgagcgttcctaccttccgccagatgctctaccgggtgatcattgaggaactcaagaaggagggcatcaagttcgggcaagatcctcacacgctctcctccagtcaatccaacacgctctatgagtgggctcaagcgatgcgctacaagccatccgctacggcctcgctgtcaccgggtcgccagttctacgtcttcctctcccgtctggagcaagtacaatgagaatgaccaacgagcaaatcaaggccaagtatccggccaccgctgagcgcatcattggggaacgccgagtcctccgtaagctgctcactgcgatcactggctctggctactgcttccgcatcaacaacggtgaggacttcgagaccaaccacacctacaccgtgcaagtgggtattgaagcctgcatggctaccgatgaggaccatgtggtggtctaccgggttcgccctgatgacggcacctaccaacgcatcggcaagttctggctggtctatgggaactccgctgaggaggtcatagcagactacagcgccatcacatcgttcgagtccatgttctccagatggttcgacgaagccaccatagacgccgagtgattcactgatgggccttcgctgagggctcattgggaacaactcaacgcaaaccacataggagatccaaatgatccacgcaatcgctcgccagtccaaaaacatctgcctgttcgctctgttcgctaccgtgatcgccctcggggccatccatgcgaatgacgctgaggcacgaggtttctcgggtagtcggtcgagtagctccagctcatcccgctcttacagcgcaccgcgtaccagctcctacaaacctgctcctcgggtcgtccagaacgtcaccgtcaaccgtaccactgtggtccatcaatcggctccagcggccatgggcggtggctctggtggcttcatgagtaccgtagcgggctcctttgcgggcacctctctggcgaactggtggaacaactccagcaacgaggagaaggccgaaaagcaacgccttgaagacgagcagaagcaacgcgacgaggccgctgcactggaacgcctcaagctggacctgctgattcagcaacaatcgggcaagccaatcgagggcatgttgccaccgggcaaataagtacctctctacgatggtcaataagagcctgccttcgcgtcgataacagcgcaaaggtgggcattctgtaccgctccatttaccgcacttcttaggtctttgaattatgcaacgctacaaccgcactaacttcacttcggctgcatttgctgaacgtctcatcgctgctatgcgtggcgctctctctgatggttacgcccactatgtggagaaccggcacgggcaacgctggctccgtgtggacgtaaaacccgacgacttcgggggctacaccttccagttccttgctggttctggtcaagacgttggcagcctgatcttgcaagcctgcttcgtctggtccgaggagcatgagcgagccttctcggggttgttgagcgaattatacacacgttccgagcatcctttgttgaccgctcgtcgtcgtgatgcagaactggaagctgaaagcaagcccaaacctgcaaaaaatcgttggaaatcagcacttaaagagacccttgggtacttgactgcgcttgcggttggtggtggtgctggacatggcctcgtcgcattgggggtgttcggatgagtaccgttctcactaaggccaccacgggcatcgcatcggttgacaagtaccatccccttctgcgtgagcatcttgagaccctcaaggagatggccgcatacgctgaggacaacggcgggatcaacccaagcaagttctctgacacgagcagttggcagaagttccttgacgattgcgtggtctgccatgcaccggggatctactcggtcgcctacctgcatccgggctactgccgcgacatcaagcacgaaatgagcaagttcgtcttcgagcccaaccttgaggagccccttgaggcgcagatccctgaggtgaccttgcaggatgaacacaaggtgctgttcgaggtcttccggtccttctgggctgacgctgggatcgcctacgccaaggtgctgttcaaccttgagcctgagaacctgaccagcgtacaggctgcccgttacgagccctcagagactccacgaggccactggcacaccgaccgggactctgatgtcactctggtggtggcgctcaacgatgaccatgtagggggcggcacgatggctgctcaagggcctttcttccctgacgtgatggttcctcagaacgaacccggctggggcatgttcttcaagggtaaaacgaccctgcactacggcctgcctgtcaccgaaggctgccgacaactactggtccactggagtgaagttaagtgatgcacacgaattaccagcctcgaaagccggggctcattgaccgcaagatcgtggctgataaagccagcgccaagaccggacctgatgccttcgggtatctctacgggtctcgcaactaccgcaagtgtttccttgaagcgatggatgtccgtctgggcaacctgagccacaacatcgagctgtacgtccagcgccaacggctgcgctacagcgaccaaggcgactttacacgctgctaccggggaggcttctgagatgcgtggcttcccgaaacgcccgtccatgctgccactgccaccggacgactacacccagcgcgccaagctcatcaagttccgcgcctcgtgggtcgatccgaacacctacgggctcgtcaaggccaaagagctgacctttgagctgggccttgggccttgtggtcgtcacgttgtcagcctgggagttgccatcactgatgacctactgacgatcaagcagtggtcacgaagccctgagctgctccatgagcctcaatgtgatgccaagtggaagctggagcggcaccagcgcttagagcgcacctaccggcctgctgtgaccctcaagcggcaagagctgcgagtcaccgggatgctctggtggcgcaaagaggaatgggtcgatgtcattgagaccacccatggtgatgcggtcaagcctgagggtctccttgaggactccgaagtggccgaactgcgagaccagatcagcaagtattactccgctatcacgaagtggaatgatgacctcgaactcaagacatttgtctacaagatggccgacgttcatggccggatcgaggtggttaagtaaggctggattaataaaccctcactgttgcgagacacctcagagggttcctgcctaaaagatcaccttaaagacatcttaaagatccctctgagataaaccttatagagcaattctataagacaactatatctcatagagcatcttaaagaatgatccccgagcgtcacgacttcgctgacatcgcaacatcctcattcgccttcaatcaactctccagcatctacggtcccgaactggccgctgagcaactgcgcttggaacacgaagcgtacacgcttggagaggaacgctttcatcgccagatggagcgccagatggagcgcggtgagttctccaacaacatcgccgctcagccactactgggcactctggtccctaagatgtccgctgcgatcaccgcatggatcgaccaccaagccaacaagggtcgtggtcgtaaacatgtgagcttcgccgctgcacagcaaatgaacccggacacgatggccgctgtgaccatccgctacgttctcaacatgatcgcccagcgccgtaatggtgccccaacggtgaccgagatgagcatcgtggtaggtggagccctcgaagacgaagcgcgctttggccgcatccgagtccttgaggctgaacacttcaagcgagccatcgccccggctctcgccaagcgcaacggtatgacctacaagaaggcgtacatggagcgggtcgaggagtcgatgctacagaagggcgaactggcccaaccgtgggttgactggaacgtcgctgactcagatgtccgattccacatgggcatccgaatgctggagctgttgatcgaatcgacccaactgatcgaggttcgccgtgatcacgctggggacaagaagaacgatggcgagtatgtgttcctcaaggatgaatgggctgacaagatccagaaccgggccttcgcactggccggtatcacgcctcagtaccaaccctgcatcgttccgcctaaaccgtggaagggtctgcaaggtggcggttactgggccaagggtcgcaagcctctgacctttatccgactcaacggcaagcaagcccgagagcgctaccgtgatgtcgagatgcctgcggtttaccgggcagtcaacatcgcacagtcaaccgcttgggcagtcaataagcgcgtccttgaggtcgccaatgcggtgatggaatggaagaacgtacagatcaaggagttccccacaacggaacgccaagagctgccactgaaaccccacgacatcgacaccaacccagacgctctcaaggcgtggaagaaggaggccgctggggtctaccgtaaggacgccgcaagggtgtcccggcgattggcctacgagttcggactggagcaagccaacaagtttgctgagtacgatgcgatctacttcccgtacaacctcgattggcgtggccgggtctacgcggtccctgccttcaaccctcagtccaacgacatgaccaaagggatcttgcaggctgcccatggggaacctgtaggcgaggaaggaatcgagtggctcatgattcacggggccaacactgcgggcgtcgataaggtgccctttcctgaacgtaaacaatgggtccgagaccatgaagaacttatcttggcgattgccaacgatcctctcaacgtcaccgaatggatgtccatggactccccattctgcttcctcgctttctgctttgagtgggctggcgttaaagctaatggcgctgcacacgtcagtgccctaccccttgcgttcgatggttcctgttctggcatccagcacttttccgcgatgcttcgagatgaacgtggtgggcgtgctgtcaacctcatcccttcggactccgttcaagacatctacaagatcgtctctgatgaagtcgagatcgctctgcaatatgacctcaagtacgggacggacgactggatcgaaactctcgtcgatgaggtcactggagagatccgcgatgttaaacgtctcggcactaagaccctcgccattgcgtggctcacttacgggatgtctcgtaaggtcaccaagcggtctgtaatgacgctggcctacgggtcgaaagcctacgggttcgctgatcaagtccgagaggacatcgtaaagaaggccattgacaacgatgagggccacatgttcacaagccccggtgaagcgagccgctacatggctggcaaaatctgggactcggtgagtgttgttgtggtcgccgctgtggaagcaatgaactggctacagaaggccgccaagctgctggcctctgaggtcaagtgcaagaagaccaaagagatcctcaagcctgccatgcccgtctactggacgacccctgatgggttcccggtatggcagcaatacacgatcaacccaacgcgccgaatcgacctcatgttcctcggggacgttcgcatccaagccaccgtgatgatgcgcgacaacgggaccagcaagatcaacgcaaggaagcaagagtcgggtatctctccgaactttgttcacagccaagacggctcgcaccttcgcaagacagtcgtacacggttacgacaaccacgggattcgattcttcgccctgatccacgactcgttcggcaccatccctgccaaagctggcgcgatgttccgggcggtccgagagaccatggtcgaaacctacgagaacaacaacgtgctggctgacttccgtgagcaattcatggagcaactacacgagagccaactggacaagatgcctgagcttccaaagatgggaacgctcaacatccgcgacatcctcaaatccgacttcgccttcgcataaggaaaccaattatgaacgccgctcagaacttcgttaagaccaccaaacgtaccctgcgtgatgactccgagatggaagccatccgcaccaagaagggcaagcgcaacaagcccgtccgtggtggtcgcgtagagtggaccccaatctgcaccggcaacgctgcctactaattcccaaccttaggagatcccaatgcaagttatcgttaccgccacttcgtccaaagttgacgacctgatcctgatcgaaacctcaaccaccatcggtgacgttacgaccaccgccaagactggctatgacgttcaagagctgatggacaaccgctttctcagtggcgaccttgagactcgcatcgaagcccttcgggtcggtgccgaggctgtgaccatccgctccgttgaggcgcactttaagaccctgatgaacatccttaagaagcccgctgaggtgactgacgtgagcgcggtcccttcgagccaactgcaaggcgtcaaggctgacgtgatgatcgtcgatgaggcccaggctgaacctgtgactgagccggtgaagaaaacccgcgctcctcgcaagcctaaaaccaccactaccgaatccaactaaggggaaccccatgtccaaagtcgaagccgttatcctgaacaccaagccattccgcccaaccgactacaacgagaaggctgtcgaggctgttctggatgagtcctacctgatcgctgatgtcaagaaggacggcgttcgtttgaacctgtgcgtgaacctgatcgagaccaagcatgaccacggttgggaagtcgagtggttgtcccgtgagggtaagcgcttcccggccttcgggccatctcatggtcctctggacaccgaccctcgctgggctgacttcttcaacgagaacaaaggcgaggggatgttccctcaagggttcatgttggacgctgagctggtcctgaccgacatggatgaccgtgaggttccctgcaagaccacctcgggcaccctgcgccgtaaagaggagtcgatcccactgagccgcatccgggtctacgtcttcgacatcgtaccaatggacgttgtgctgagtggcgaggaatacgaggtcttccagtgcgtccgtaagatccacgttgagtatcaggtagccaagctcaaggaatacttcccagagatccaatggatcgccgctgagtcctacgaggtcttctcagtggagaccatgccagtggttgagcgtgaaggcttcgacgaggagggcaacgagatcaccgtaaagctccaaccgccactctcgctggtccagctctacacctcggtgcgtgagcgtaaggaggagggtctggtggtcaaagatccgatgggcttctatcgccgctcgaagtgcaacggctggtggaagaaggtgccgagcaacaacgaggacggcaaggtggttggtctggtctggggctcgaagggtaaagccaacgagggaaaggtgatcggcttcgaggttcaacttgagtccggccatgtggtcaacgcttgcaagatcagtaaggcccagatggaggagttcaccaagaaagtgatggaccacaacggttatgacgttgaggacatcgagtcgatcatctacgggatgggcagctcattggttgactctgagaacccgtaccaccaccacatggtccgagtcacctgcatggaacgctaccctgatgggtcgatgcgtcacccgagcttcgacgagttccgtggtatcagcgatccactcatcaaagagtaactaaacgagcctcatcgacttcggtcggtggggcttttttgtgcctgtctgaataggagaaatctatgatcaagttcctcatgatagttttcgttgtgatcaccttcgccatccttatagctggcttcgagcctgaccggactcccgtggagcgcctctacgacgacgaggattaataaaccctcactgttgcgagacacccaaccaaccaccgaaaggagatccaaacgatgcccgttaaagaccgttcgttcgcctaccgtctgcaccaatcgaacatcgaccgtcaacgcaactgcgcccggttcaacatccgtccacctaaaccaccagcgccaaaggccgacttctggcagcgcaccaagacgttcttcaagaacctctggaccaagatcaaggagatcgtcaatgactgacatcatcgccctgacttctgagcgtggtcgtagcggcaaagacactctgtgcgagcttctgatgatcgagggctaccgggtctaccgggtcgcctttggggatgtcctcaagaagcaatgcagccacatgctggccctcgacgaatgccaacgcatcgttatggagagccacatgcacaccgacttcaaggacgctcagttcgaggagttggcaatcgaggcgatccctgagagcgagtacaaggactggctgctgaatgagccccagatcctcgacatcgagatcccaaggacacctcgctggcacctccagcaatacggcaccggcttccgtcgcaactataagcagaacccggacgtgtggctgctggagggtctcaaggagatcaagaaggctcccaaggatgccctcgtggtcgtcactgacatgcgtcaagccaacgaatatgcagcactgagcatacgccaagcgcacctcgttcgtctctcccgagactgggcgatccctgctgtggatgaccagccgctacacactactgacattgaactgcgtgacttccaaatggacgccgttgtggtgaacaagtggggccacgcctcggagatgatcgaccaactcagaactcaaggagtaattactcatgcctaagcaagaccagaaaatgaagaagttcctcgtcaccgtggagtaccgcaaggaggtccaagaggtgccaatgtatggccgcaccattgaggaagcgctcgaagctgctgaccttgagtacggtgaggacaacgttcgtcgcattcgcccggaggtcactcaatgaacctggcccaaggcaacacccgctcgatgcctgatggcttcctccacatccagaacttcaccgtgaccaagcacgcggggatggctggcgtggtctacatccacatccttgacgcccatcaacgtcagttggtcgaagggctgctcattgagcgcgccatcgtgaccgctgagctggaaggcaaggagctgcaccacttcaaacacggctgctggcggttctccaaggagttcctcaagaacaacttccgtgaggtcgtccatgcgatgaccaaggtgacgctgatcccggtcattgagaccttcaagcagaccctgttcaccgagcgtgaatccctctcgtactgaataaaccctcactgttgcgagacacctaccttcccactttcataggagataatcccgatggcaaaatccaccaagcagttcttctttactccgaaaggcgtagctgaaccttactgctcgatccaaaagccggactacggaaacccagagaaaggcttcggcaaccctcgtggcgtctataaggtcaacctgaccgtgagccgtgctgatgcccagccaatcatcgaccgcatcgttcgtatgcaggaacaaagctacgcggcaatctgcgaggacttcgagaagaaccgcgcatcgctgaccgccaagctggcccgtggtaagaaactgctggaaccctatgagggcgacctgccgttcttcgagaacgacgatggcaccgtgacgttcaagttctccagctacgcctcgtaccaagacaaggaaaccaaagagaccaagccgctgaccttgaaggtcgtggacgccaagggcaagcgcatcgacgctgttcctgcgatctctggtggttccgagttgaaggttcgcttctccatgttcgcctacaccttcggtgccgttgtcggtgcctcggtcaagctgcaactggatagcgtgatgctgatcaaactggtcgagtacgctgctggcaatgacgactgggctgacgaaaccgaagaaggctacgtcgctccagagcgtgaagaaagctgggacgatcacgaagaccaaggccatgctggcgaggtcattcctgacgctgcctcggacttctgatggctggctacgctggcccgaagggcgctcgtacaggcgcttttcgatccggccttgaggaccgcaacgcggctcacatggacaagctcggagtccctttcgacttcgagcagtaccacattaagtacgtcgttccggcccgtgaggccaagtacacacctgacttcgttctgcgtaacgggatcatcgtggagaccaaagggatatgggaagtggacgaccggaaaaagcatctgctgatccgtgagcaataccctgaccttgacatccgtctggtcttctcgaactccaagagcaagatctataagggctccccaacgagctacgccgacttctgcacgaagcacgggatcatgttcgcagacaaactcattcctaaagcatggctacaggagaaacgtaaggagatcccagcggggatactccatccgaaaggaggtaaatgatgccaaaggctgctttcaagaaacgcccaagtacgaccctgctcgtggtccattgcgcggcaaccaaaccgaccatggacatcggcgttcgagagatccgccagtggcatgttcaacaaggctggctggacgttggctatcacttcgtcattcgccgtaacggcactgtcgaggatggtcgccctcatgacgtcattgggtcacacgccaagggctacaactccacctcgctgggcatctgcctcgttggtgggatcaacgccaagggcgccccagagaacaacttcacgcctgagcaattcaactcgctcaagctgctgctgatcgctcacaagcgcacctatccgcaagccaagatcgtgggtcaccgcgacctcgactcgggtaaagcctgcccgtccttcgacgtggccgagtggctgaaaactcaagggatttaataaaccctcactgttgcgacacggcctcactgacttcggttggtggggctttgttgtttttaaacgttgactttaggaggtcattatgaatcgttccttactgcaaggtgggttcgacctttgtgagcatctcattgaccgtggcatcggcgcgattatcgctggtggctgtgcccgtgacctgttcttctcggttgagcctaaagacatcgacatcatttgcgcgggcaccgacccggagactgtttccagagcgctcgatgaaggtggttacacctaccacaagttccccaagtaccacaccggctccgactctgatcggctgcaaggtgtctggaaaatcgaaggctgcgagatcgacgtgattctttacgaggtcgagtgtgtcaccgaggccatccagaagttcgactacaacctcaatcagttcgccatctcgggcatccaaaggggcatcgaaggggcaaccattcgcttcatgggcgctcacgcttggaccaatctggttcaactgcgagaggacgctcgtggctcccgtgctgaaaagatggaagccaagtggctggacctgatccacaaggcaccaatgcgtgatggacgttacgtcgatgagatcgaggtggccgatgtcgtcgcatgaggaacgcgaagaaagcgttttccttgcgcatatcccgtgtgaggaatgtgggtcgtcggacgcaaactcgctgttctctgatggtcaccaatactgctttgcgtgtccccctgagactgcctataaggcacccgatgggaaggagcgtggggagttcacaccgaggctcaaagctgatggcacgctctcgatgggcgaggctggaggctacttctcggcgctccctaagaggttcctacaggagccaatctgccgcctctatggttactggatcggcaaggcgttctcgcctcacgagggcaaggaagtcccggtacagatagccaactactacgacaccgagggcaacctcaagtcgcagaagtgccgtcaagccaacaaggacttcttcaccaagggcaagcacgacaaggacgctctgtttggtcggcacctgtggaacggtggtcgcaagatcgtcgtcaccgagggtgagatcgactgcctgacggtggcccagatccaaggtggtaagtatccggtcgtgtccattgggcatggctcgaaggctgccaaggcgacctgtgcggccaactacgcctacttcgatcagttcgacgagatcatcctcatgtttgacatggatgagcccggacggattgcctcaagggaagccgctgaggttctcccaccgggcaaggtcaagatcgcagtcctgcctttcaaagacccgaacgagtgtctccagaactcccaggccaaagctgtgatggacgccatgtggaacgctgccccattcgtaccggatggagtggtctctgcgaagtccctcaaggcccgcatcaaggagaagaaagcagtcccgagttatccgctcgtggctccttacgaactccgcaagatgaccaaggacatccgcgaaggcgaggtcgttctggtcacctctgggtccggctcaggcaagtccaccttcgttcgtcagaacacttacaacctgttcaatgactgcgggattcccgtaggcgtggcgatgctggaggaggccgttgaggaaaccgtacaggacatcgtagggctccacatggggtcacgagttcgtcagaaccccgatgagaccaccgaggagatgttcgacaaggcgttcgacgagatcttcgagagcgacaagctgcacctctatgacgccttcgctgagtccgctgaggatcgcctattggcgcgactggcgtacatggtcgaagtcaacggctgcaaggtgatcgtactggaccacatctcaatcgtggtctctgcgatggacggtgagaacgatgaacgcaagatgatcgaccggctcatgaccaagctcaagagcttcgccaagaccaagaacgttgtcgtcttcgttatctgccacttgaagaacccggacaaaggcaaacctcacgaggaaggccgacctgtcaccgctaccgacctgcgtgggtccggtggtctgcgtcaactgagcgacaccatcatcgctgtagagcgaaaccaacaaggtgccaaccctaacctcatcctgttccgactcctcaagtgtcgattcacgggcgagacgggcgtggctggctacatggaatacgacaagcggactggtcgattggtagcgaagcctgagggctggcgacctgaccaagatgcaactgacgaagctgacgctgcatgggcagaccagcaagaacccgacttttaaaggagaaccaaaccatgaagaacttcgacctcgtaactttcctgatcactctggctggccgcattcaagagaagcgtcacgctcgtctggtggctcgtgaagcgtccttgaaggctgccatcacggctgctcaaaacgccctgcaaaccaccgtcgatcaacgtgtgcaagctaagtggaaacacgaagacatcaagcgcgtgagctgatccaagggcctctctttgaggggccttttagtgagttcacacatcaacgctacaggggggggaatacaaatgaatggttctgacgttcgcaagttcatcaaacgtggtgagcaggccgctgaggtactcgaaaagctgggctactcgtacatcgagaaggctgggcatcacccacattgggaagccccagtaaacccgatggacccaatccttgaggcgctcaacaagatgatcgctgagaaggttgacgctgacatcaaggcccgcattaaggacgacccaaggggtccgaactggcacctcgttgcgccaatggtgggcaaggacttccgggtccagtgcgccaagatcccggccaatagccaactggcgtcattcgcctttggtcctcacttcgctggcaagttgttccgcgccatcgagatccgctatcaccgctccgaggagtacaccggctatgccgtgctgttccacttcaacgtgcgcccgtatcgcccagaagtcgtatggctgcctttgagcgctgtcgccttctccaactaaggagggcctcatgctcatctctgacatcgaaacgaacgggctctatgagtccgtcactcggttccactgcgccaccattcaggactatttcaccgggcaatatgttcggtacaacgagtccaccttcaaggagtacatcgctgcccttgaggccgaagctgccaagcctgacggtatgatcgttgggcacaacttcatcaagtacgacatcccggtcctcgacaagctcaagcgtctctacttcggtaagcgtttgaacatcccaaggaagcgcgtgatggacaccctcgtgatgacccgtctggtttactccaacgttggtgatcgtgactcgggtctcatgcgttcgggcatcctccccggcaagatgtttggctctcactcccttgaggcgtggggctatcgtctgggcgagatgaagggtgaatacaagcacgacttcaaggtccagcttgagaacgatggtggcgtctacgttgacggtatggagtggctggaatgctccgagtccatggaggactactgtgagcaggacgttcgggtcacctcgaagttgttccgcaagatcatctccgacctgcactacttcaacgatcaaggcgaggccattgaggccatccgattggaacatgcggctgcgtggtcgctggcccagatggaacgcaatggcttccccttcgacatcgagggagctgagaagctctattgtgagctggctggtcgtcgtagcgatctcctcgtggaactcatccagacctttgggtcgtggtggtctccgaaaggtggtaagtcgcagttcctcaacccgaagactggtgcaccaatcgactactggtctgatggccgtgtcatgccgaaggtggtctatcccaagatcggtggcgtgttcctcaagagcggcaagaaggacacccgagagaccttcgagggctgcccttacacgccaatcgaactggtcacgttcaaccccggatctcgggcgcaccttgagaaagtcctccgtgatgctggctgggttccgaccgagctgaccaacacgggcgctgccaagatggacgatgagacccttgagttcgtccgtgtggctgaccctaagaagcaagcgtgcatcaaccttgtgcgtgagttcatggaggtcaccaaggtcattgggatgctctctgagggcgacaaagcgtggctgcgatacgtccgtgaggatggctgcatccatggctcagtgaaccccaacggggctgtaacaggccgtgcgacccatagccacccgaacatgggccaagtgcccagcgccaagaagaagtacggacctgcgtgccgtgcgctctttggggcggtctttgcgaggaagctcaagaagggctgggagaacgccgtccagttagggactgacgcctctggccttgagctgcgctgtctgggtcacttcggtgcgccattcgacgaaggttcgtatgccgagaccgtgttgaacggtgacatccactgggtcaatgcgctcgctgctggcatcgctcctcctggcctaatccgtgacaaagagaaccatgaacatgacgcctaccgggacaccgcgaagacgttcatttatgcgttcctctatggcgctggtgatggtctcgttgggtcgttcgttggtggtggcaagaaggaaggcaaggcactcaagaaggcgttcatggagaacaccccggccatctccggcctgaggggagcccttgaggagcaactgatctccgagcagaagtacaacaacgtcaccaagaagtacgacatcaagtggaagcgccgttggatcaaaggtctcgatggccgaaagatccatgtccgctccccacactctgcgctcaactcgctgctccagtccgctggtgcgcttgtgtgtaagaagtgggtcgtcgaggtggaacgcattctcgtcgaggagcatggccttgttcatggctggtacgacgacgatggcaaccccggtgacttctgcttcatggcgtgggttcacgacgaactccagatcgcctgtcgcaaccaagaaatcgctgagctggtcgcaaaggtctccaacgaggccatccgactggtaggcgaatcattcaaattccgctgcccactggctaccgattccaagatcggcccaacgtggcgcgagtgtcactaaggagatccttatgagcatgactctgaaactgaacgtgtccttcccgatgaccatcgtggtaaagaccgagaccctgaaagccttcgacgaaacccgtgaggaggcccgcaagatccccgctgaggagatcgccaagctcaagggtgagaccaagttccgcgctgagctgttccgtggcgaccgtaccactgagcaagtgatggagctgatctaccgtgctggcatccgtgagctgatccgtaaggaactggtcgaggagatcaccggcaacgaatcgaccgcccgactgggctgcatcaaggtgacctatgaggccccacctaagcgttcctgtcagggctgcattgagaccaactgcgtgatggccgagcgtaacactaacgctggctgcgacaacaagcgcactggtgtccgtgagcccggtcctcgttggactgagacggtatgaatgagtacctaaaggttctctgggaaatcaaaaagcaagcgaggtcgtatcaaagcgacttcgttcgttcccgcattgcgctggtcaacgaggcttcatcccgaggccacatctcgtgcctatcaactgccggtaagaacatgggtctctggaccttgacgactgccggtcaagactttctctcggaatatggaggtgccgtttgagtaaactgaaagtgggcctcgcccatgatatggactacctcatcttctcagcgatgtccgctgctgaggaggagcaggactggggcgaagacgtatggaccctgttctgcgatcacaagaaagcccgtgacattctgttcggcaccatcaagaccatcaaggtgaacatcgccgcacaactcaagcgcaagttcaagctcactgaggacaagtacgagttcgtggacatctgcatcctgagcggtgacgacaactggcgtaaggatgtccttgagacctataaggccaaccgtaagggcaagcgtaagcctgtgggctaccgcaagttctgcgatgagatcatggcgcactacggtgacatgtctctcaagtggcacggtgtcgaaggtgacgatgtttgtggcgtcctgatgactgacccgagcatcgttaagtgtgaccgtgtgatcggcgtgagctgtgacaaggacttcaacacggtgccgggatacttcttctggctgaccgagcaggaactcatcaagaacgatgaggcaacctctgacctgcaccacttctatcagaccctcaagggcgacaccacggatggttatggtggcgtaccgggagtcggtggcgagttcgatggtggcctgatggattggctccagtctccgaagttctacttccaagacgtgaaggtcatgaagtccggcaaacgtaaaggcgaggaggttccgttctggacttcccgtgagcctgatggcgagtccctctgggactgcatggtgtcgctcgctgccaagcagggaatgactgaggaggagctggtggtccaagcccaagtggctcgcatctgccgcgcttcggacttcgatatggagaccatgaagcccatcctctggcgtccctaatttaccctcactattgcgagagggagcccagtgttcccttaaggagtcctattgctcaagcagatccaacactacatccaaaacccggatgacatccctgacatctctcccgcatctgccgactatctcaacgtccgtctcaacgcttcctatctgatctccactggtgctgtcgatgatctccgcaaagcggggttctccgagcagtacatcatgggcttcattgacggatgccatggggcgactgagatcgtggagctgatgcaggaggctcaactaaacaaggaggaatgaccatgtgtttcaagtccaaggtcaagaccccaaagaccaaccctgatgctgtgaaagcgcctgagccggttctcattgaggaacctaaaggcgtggacttcggctcaaccgaggacgatgacacctccagcgatgagggtctcgatggtctcaaggtcaagaagtccgatgtttccacaaaggacactggcgatggttcgtctgatgctgtcgctgctgatacgggcaccgggaccatcaagaagtccaagcctgctgcatccatcaagaaggctctcaagaaggtcactaagtgaacctggctgcgcatgtccagaaggaaggtcacccggcctgcttccgtgaggtgctgagcgacatccttgaggaactcactgagctgacgtggggcgggtccagagtcgaatgctacgagcgtatctgccggtcaaccgaagaacttgacgaacgcatagagatcaccgtgagagacccgcaagggaagctcgtggggttcgctgtggtcgtcaacgatgaggatgaccatgtaggtgagtgcctcggaacgcaatggcactgggttcacccggaccaccgtggccctgtgggtcgaatgatccttcgggcaatcgttaggctggcctccaatgctggctacaagaccgtggcgtacacgaagcgcttaggcgtgggtcgctacgagatcaattacaaacaactgaaggagaacatccatgggcaagaaaattaagaaggtcgtcaagaaggtcaccaaggctgtcgttaaagtcgctgacccggctggcgttatcaaggaagcaactggcggtaacgatgcacctgctcaggtagtcgaggcccctgccgcaccgacccctgtggctgcccctgcgcctgtctcagcggctgtcgttgaggccccgaaggataccactgagggctccgatgatgctgacaccgaggctgccaagaaggctgcccgtgcgcgtggtaaacgtggtctgagcgtggctcgttccgctggtactggcatcaacatctaaccaaggaggtgacccgtggcgactacaactcgcaccgggctcgctgaggagggcgcaaaggctgtttacgaacggctgaaaaacgaccgagttccctacgagacccgtgctgaaaactgcgcgaaggtcaccatcccctcgctgttccctaaagactccgacaacgcctctactgactactccactccgtggcaagcagtgggcgctcgtgggctcaacaacctgtctgccaaggtcatgctggctctattcccgctgcaaagctggatgaagctcaaggtgtccgaatggcaagcgaagcaactggtctccgacccttcgcaactggctgtcgtggaacaaggcttgggcatggttgagcgaatcctgatgtcctacatggaagccaactcgtaccgtgtgacgctctttgagctgatccgtcagttggcccttgcagggtccgctctgatctacctgccaccaccagacgcatcgtcgtctgcgtacaacccgatgaagctctacacgctccacaaccatgtggtccagcgtgatgccttcgggaacgtcttacagatcgtcaccgtggataaggtcgcctttgcggctctccctgaggacgttcgcaactctcttggcgctgatggcgagcgcaagcctgaccaagagatcgaggtctacacccatgtttatctggacgatgagtctggtgagttcgcttcttatcaggaagtggatggtgtcgaagtcgatgggtccgaaggtcagtatcctctggatgcctgcccgtggatcgctgtgcgctggaccaaacgtgatggcgagcattatggccgctctcatgtcgaggaatacctcggtgacctgaactcccttgagtctctccatgaggccatgatcaagttctcgatggtcgcctcgaaggtgatcggactggtgaaccctaatggtgtcactcaggttcgtcgtttggtgaaggctcagactggcgactttgttgccggtaagaagtccgacatcgagttcctccagttggagaagaccgctgacttcacagtcgctaagtctgtcgctgatgccattgagcaacgcctctcctacgtcttcatgttgaactctgcggtacaacgcaagggcgaacgtgtgactgccgaggagatccgctatgtggcgagtgaacttgaggacacccttgggggcgtctattcgattctctctcaggaactccaactcccaatcgtccgcatcctgttgaaccaactacaggcaacctcgcagatcccagacatgccaaaggaggccgttgagccaactgtcagcactggtgtcgaggcactgggtcgtggtcaggacttggacaagctcaatcagttcttgagcgcaatggctaacgtgagtcagctacaggctgatccagacctcaacatgagcaacatcaagttgagactggcgaacgctataggcatcgacacgtccggtctgctgctcactgaggccgagaaggctcagctccaatcccaagagatgctcaagcaaggtggcctcaacgctgctgctggcatcggtcagggtctcgctcaacaagcgaccgcaagtccagaggccatccaaggcgctatggaaactacgggcatcgaagcggccccgatttaataaaccctcactattgcgagacacacgttctgccaagcaagtacatctgggaaacctcggatagtgcccgaggcgtgtgtctctccattttctaaaggagacccaatgagcaacgaatcccaagctgacgtctatgcacacttcggcgtgaatagcgctgtgatgaccactaccaacatcaccgagcatgagcaagcgatgctggcaatgcccgtgtctgttcgtgatggcgatgactccatcgagatgcactacgaggacgccgaagaaggctccaacgagctgcaactggataccggcgaggacaactctcaagagctggaattgacgaacgaggagggcactgacgaaggtgctgactccgatgagttcgtccctctgggcgaacctgacgctgacctgatcgaagcctctgaggccgtcgatgagtacgctgatggattcactcagatgcgcgctcaagcgatcaaagcgggcctgccacaagaggtcgctgaccagatcgaggccgagtatgaagctgacaacaaactctctgaggcgtccttaaaggcgctggagaaggttggctacagccgtggcttcgtgaagtcgtttatcagcggtcaagaagcactggctcaaacctatgtggcccagatccagcaatacgctggtggtcccgagaagttcaaagccatcgtggctcacatgacggccaactcccctgatgctgttgaagcattggagcgagccatccagaaccaagaccttgcgtccatcaagacgctgatcaatctgggcatggcgagccgcaccaagaagttcggcaagacaccggaacgtagcgtcactaagcgtgcccctgcaagtggtcctaaacaggcccctcaaggtccacaaggctatgcgtctcaggccgagatggtaaaggcgatgggagactcccgttacgctaccgacccatcttaccgtgcccaagtcgaagcccgagtgctgcgcaccaactggtaattaataaaccctcactattgcgagagatacctatccgattccttcggaggatctcttgcgcccttaagaatttcacaaaggagaactaatacatggcgaacatgaatggcggtcaacaactcggcgcgaaccaaggcaaaggccagaaccctgctgacaaactggcgaacttccttaagctgttcggtggcgaagtcctgacggctttcgtccgtcgctccgtgaccatggacaagcatatggttcgtaccatccagaatggtaagtccgcttcgttccctgttatgggtcgtaccaaaggttactacctcgctgctggtgagaacctggacgacaagcgtaaagacatcaagcactccgagaaagtgatccagatcgacggtctgttgacctcggacgttctgatctacgacatcgaagacgcgatgaaccactacgatgtccgtgctgaatactcggcacaactgggcgaagctctggctctggccgctgacggtgctgtactggccgagatggcgaacctgtgcaacctgcctgccgctaccaacgagaacatcgctggtctgggcactgccgttgttctgaacatcggtgctgctgctgacctcgttgacgttgaggctcgtggtaaagcgatcctgaaaggtctgactctggcccgtggccgcttcaccaagaactacgtccctgctggcgaccgtcgcttcttcacttcccctgacgactacagcgcgatcctgtctgctctgatgccgaacgccgccaactactcggcactgatcgacccagagaccggcaacatccgcaacgtgatgggctgggaagttatcgaagtcccacatctggtcgctggcggtgctggtgatgacgacctcggcactaaccagaagcacgccttcccggccactgctgctggcgatgtcaaggtagctcagaacaacgtgatcggcttgctggttcaccgttcggctgtcggcaccgtgaagctgaaagacatggcgctggaacgcgctcgtcgtcctgagtaccaagctgaccagatcatcggcaagtacgcgatgggtcacggtggcctgcgtcctgaggctgctggtgcgctggtcttcaccccggctgcctaaagccaactaaccccttggggctcctaaccgggctccttggggttttttttcattcaacgaaaggagatcaacatggcctatgaatcggtcctcgactctgatgacgaactcgatgctgtcaatgacatgctcgctgccatcggtgagtcccctgtaagttccctcgaaggtgaccctaacgctgacgtagcgaactgccgtcgcattctctccaaggtcaaccgtgagatccaagcgaagggctggacgttcaacattgaggagggcgcgatccttctccctgacgccttctcgaagctcatcgagtacctgcctgactacctgcgcatgaccacctcaggcggcaccctgtacatcaaccgtggtggattcgtttacgaccgcaccgcgaagactgatgtctttgaaaacccaatcaccgtggacctgatccgcctcaagcaactctctgagatgcccgagtgtttccgctcgtacatcgtcgctaagtcctctcgtcgattccaaacccggttcttcggtgctggtgagatcgagggctccttgcaggaacaagaggctgaggcttgggcgtccatccaagagtacgagctggacttcggtggcttcaacatgatcacaggcgatgcgttcgtcggtggtatcaccaaccgctaaggagggcctatgggactcgtttcgcaaagcgtcaagaacctcaaaggaggtatctcgcagcaaccggacatcttgcgtttctccaaccaaggtgccatgcaaatcaatggctggtcctcggagactcagggtctacagaagcgaccaccgaccaagatcatcaagcgtctgtacagcactggcgcactgggcgtgaagcctctggtccacatgatcaaccgggactccaccgagcaatacttcgtgtcgttcttcgggtccggccttacggttcatgacttggctggcaatgagtatctggtccgtggttacaacggctacgccaactgtgcgaaccctcgtgatgacctgaggttgatcaccgtggccgactacaccttcgtgaccaaccgtaagactgtcactcagttgggcggtacgctgactggtgctggacaacctaacgtgaccactcgtgggcttgtgaacatccgtggtgggcagtatggccggaccatgcagatcctcatcaacgggggcgtctacgggaacatccagatgcctaacggttccgctgagaaggtgcctgctgggcagccttacgctggcatgaaccaagtggacatgacggacgccaactggatcgcctcaacgatggccgctcagatcaacactgcgctcaacgcctcgggctggtcggcaacctctggccccggctgggtcatgatcaccgctcccggccccggtgggtttgtttcgctacagaccaaggatggctacggtgaccagctcatgaacggcttcatctaccaagtccagacgttcaacaagttgcccgctcaggcccctgatggatacctcgtggaagtcactggcgagtccgctcgtactggcgacaactactgggtccaatacagcctcgctggtaaggtctggaaggaggtggcgaagccggggatcatcgctgggttcaatagtgcgaccatgcctcacgccctcatccgggccgctgatggtaactttgattggacccctctgacatgggatacgcgccagtgtggtgacgatggaaccaacccaatgccgtcattcattggtgatcggatcaacgacatcttcttcttccgtaaccgccttggcttcattgcaggcgagaacgtgatcatgtcgaggaccgctaaatacttcaacttcttcccggcctccgtgagcgctcttagcgatgacgacccgattgacgtagcgatctcgcacaaccgtgtgagcatcttgaagtatgccgttccgttcgctgagcaattgctgttgtggtcggaccaagcccagttcgtattgtcgtccgctggggttctctcctcgaagaccattgagttggacttgacgactgagttcgatgtctctgatggtgcccgtccattcggtattggtcgcggggtttacttcgctgcacctcgggcctcctacacgtccctcaagcgctactacgcgatccaagacgtgagcaacgtgaagtccgctgaggatgtctccgcacacgttccgagctacctgccaaacaccgtgttcaatctggcggggtcaggaaccgagaacttcgtgtcgatgatcagtaacgggcaaccgggcaacctgtacatctacaagttcctgtacctcgacgagatcctccagcaacaatcgttctcccactggaacttcgggaccaacgttaagatcctcgctgcgtactcgattggctcctacatgtacctcatgttggatcgccctgaggggatcatgatggagcgcattgagttcactcagtccaccatcgacatcgctcaggagccctaccggacctacatggaccagaagaagctcatccagatcggtgcctatgacatcgacctccaccgtagcttcgtgagcatcgaatccattctcggtggcctgccatcgggcgactccgtgttctacacgattgaccagcaaggcgtgatgcagcgacatgaaggtccatggccttcgggttctggcttgtcctttccgggcaaccgggctggtgagtatgtggtcttcggtcgtgagtacgagttccaatatgagttctccaagttcctcatcaagcagaccgctgacgatggctccacctccactgaggacatcggtcggctccagcttcggagagcatggttgaactatgagaactctggcgcgtttgaggtcaacgtcaacaacggctccactcagtacgtctacccgatgtctggtggtcgcctcgggactcaaacgttcctcggtgagctggctctggggaccgggcagttcaagttccctgtcaccggcaacgcccaggcacaacgagtgacgatcagttctgcaaaccctaacccactcaacatcatcggatgcggatgggaaggtaactacattcgccgttctggcggtatctaattgactggcatggtgggggtttatttaccctcactattgccctatggggggatctttatgattttacagaaagcacaacgctggcacctcgaagctgctgcacgagacctcagtcccggtgacctccaagagttccactcccacacggctgggcgcgatccacgagacaccatcccgaactgcctcgatgacacctcaatggtgatcactaagggcgctctggtggtggctgtaggtgggtccaaagattgcctctggtttgtgactaccaacgtggtgggcctgctgaccaaggctgaacgtatggagttctatcggatgcttaaagggcatctgagcgtactcaggctgcaaggccatcaatccctgaccaacttcgtgtcagtggacaatcacgcccacatccgtctcctcaacgctctcggtgcgaccttcgcccgtgaacaccacatgagtcctgccggatgtcggttccgtcaattctggctataggaggtcaccatgtgtgaaccagtaagcatcggcatggctgctgttgcggtcgtcggtggggctatggctgccaaggacaaggccaagggtgagggtaacgctgaggatgctcaacgtcgcaccgcccgagagcaagtcaagcagaccaacatggctaacgccaacctgcaactgactgcccaagaccgccaagaggaggcccgagcgcaactcgctgaggtcaacatgcaggcgctcaagaacaaaggaacggtggctgctgccatcggtgagtcaatgctttcgggcaactccatcaagcgtattgcgaactcagtggatgtcgaggccagtcaacaaaagatggcgatcaccgacaactacaagcgcgactattcgtcgatctttgcgaaccagattgccaacgtcgagaacaccaagtcggccctcaaaggtcaggcccaagtgatcaagaccagtggtctgagtcatgcccttgggatcgtctctgcgggggccaatggctacgccgctgggtcgtcattaaaaggtcagatgaacgccaacaaggcaactggacaatccaacggtacagctaaaggaggaacttaatggctaatgaaattgcacgagctttagactcggcccaaatgggcggtaaggaacgccttaagggctccactgcgaccgtccagttccaagcctctcagcaacgcgctgacgtgggcaacaatggcttcgctgactccatggcgagcttcgtgaaggccggggcgaatgcctatggcacctacgctcaggacaaggcgaagaacgctcaggctgagtcggacaagatcatccggtcgatgtccctccagcaacgccgtgaggctatcgcagcgggaaccctgcacctacaggatgaccctgacgtgatgaacgtcctgcgtcacgacactggccggacggctgcctttgaggtggagtccgagatccagaacaagctcgcctctggtgagttcgacaaccaatcccgtgaggaactggatgagtatcgccggacccgtctggagatggtctctcagtcctacgctcaggaagcgggtattgaccctaacgatcctgactaccagcgtggctttaacgccgacatcgtgaagcgtaatgcgggcctattcgacttgcatgaccagcgacgttcccagcgctacattgctcagactgtggtcaacactcgtggcgacactggtggtcttctggatgaccctgagttcatgcgtggtccgggctctggcatcgagatggctgcctacttcaaatcgaaggcatcctctggggcaatcccaacggaccaagcgctcctcgattcagtcaacctcgtgatcaacgatgcggtccagaaggaccacggatcgaccttcctcaagaacttccgagatcagacgatcaccgtgatggggattgagcagaaggtcggtgacgtgatcggtcaggagaaatacgacaacctgatcgccaagtccgctgaggccacctacaagcgcaaccaaccaaagttcgagaagttccaactggatctcgcttcggctgaggctcaggctgacccggctcgtggttgggacatgatcaatcggatcgaggccgagaataagtggattcaggatggtgatggcttcactcagcaaaagcaggcggtcaccagtaccaagctcgccatgctggcaaagatgaaggcccacactcaggctacccttaaggcaaccgaggaggcgatgcagacggacaaccgcttgcaggccatcgacgaccgctacaaggctcgccgtaatggtgccctattggggaccgctaagcaggacatgcctgtcgatgccaacactggagagttcaaggagtccgactgggcgacctacgctcaaaagaagctggctcagatcgaggccatggacatccctgtggagcagaaggatcttgagcgaggccaactcctcaaggacgaccacgagaatggtcccttccgtcgaggcttccaaacgctgatcgacgatgcagccaaggagtggcaaggcgctgttcaattgggcgaactcggggactccccaaagatcgaccaactggcacgggtctatgcccagcaaccggaactcattgcgtcactctaccctgagcgagctggcttcatcgaaaagatgaaccagatgaagcacgttgggattaacccatcggtcctcattgcggctgacgtgaagaactccaagctgaccaaggaggagatgatccaacggaacatccaatgggatgccctcaagagcgaccctaagaacaaagacctctcagcgattccgaacgacatggacaccatggctcgttctctctatgacgccttcaacgctgcaactggcgacccaacggctgcctccaagttgctctccaactggctctcgaagaacaccgttagcttccaagctggcgatgacgacgaggatgtccagaccggctatcaagggatgatcaacaagaaggatctcatggccgacccgaacgacgttaactcgtgggagcagggtaaggccatcgttgaggagaccgttaagggcatcaaggctgctgacccgtactgggctgactcgcctgtgaccatcaccgcttctcgaactggtgacatcaagatctccaccttgactggtgaggtcgtgaccatcaagaagcaatccctccagctcatctacagcgctcgccgtcaggcggaactggaagctcagaaggccaacaaggctgctgagtacgatgaggacgtgaaggacgcacaacgcaatcaaggtctctacaaagactttatccgagggggtcgtggccctctctaatccaatttaggaggaacacatggctaagaaaacctacgctgatgtcaaggccgctggcacgccttacgatggtttgattcgtgaggctgctgatgccaatggcgtgagctatgactacctgcacaaaaagatctttaacgagtccagcttcaaccctcaagctcagtcaccgactgggcctcggggtctgggtcagttcactcgtgccactggcaaggcatatggtctcgttacagacgaggacttcttcgaccctgccaagtccatcaatgcgtccgctcgccacactgcggacctcctcaagacctacaaaggggactacctcaaggctgcccttgcgtacaaccaagggaatggccgcttaggcgctccccagttacaagcgctggatcgtggtgacttctccaagatcgcccctgagggtcgtcagtacatggcgaaccttctggacgtggctggtgactctccgtcccgcaagtggttcgagggtccagatgccccaaagctaaccgctgagttccaagaggctacccaagggatctcagcaacaccatccgttgaacaaggtagcctcggtggaaacatcgggatgaacatcgggggctccactgcgcctgcccaagagaagtcgttccgccaaatggagatcgagcagaacggcccagagaagggcgcatggtacggctcctctgaggccatgttggctgccttgaagacctcgcttcccggccagatctaccggaacatcaccgtcgaggatcatgacccactggagtggatgcaggacacgggcgaccgtgagtggtccaaggaggactacgaccacatccgtaatgaaggtgtcgattcgcaatacttcgacttcattggtgactacacccggtacgacaagcgcaagctgcctgaggccatcgctctcgccaaagagaacatggctcacgacaagaccatcacctccgctggctggggcggtcaattggctgctggtggcgttctcgctgctactgacccactgacctacgtccctgttccgggcaccgctctgcgaacctttggtggccgtgtgttggctcaggggacgttctcatctggtgccgctgtggctggtgagggcatccgtgaggcgaccactgggatcgaaggtcactacgctaccgctgctgtaggtggtgctgtgatcggtggcaccatggccgctgtcttggacaagtggattgccaagtcactcgttaagcctgggcgagaagacatgagcgatgaggaactcgaaagggttcttgctcgccacggtgaggctggcctccagtccaacgatgtcaaagtcgatgaggacatgctggcttccgctcgcccctctaaggttgacgatgagatggacgatgagtacctcgaaaagatcctcgggatgcacggtgagcgctcccacaaacaagagggtcgaatggaagtctctgacgacaccgttgagggcatccttgcgaggcaccgagagtcgagccaaccgaacgagttcatgggtccaaccatccgcatcaatgcccgtgagcaagctcgtttggctggtgctgatgaccctaccgttatggcatggaagtccgatgagacccctgacgaagccttcgggattcagtacatggaccacccaaaggaaccgggcgctgtgcgtctgcctgatggttcgatcctctctgccagcaacccgctgaaccctaagctcatcaaagcgatggcctctctggagcctgagcgagccgctgctgggttcaagttcgggggccttactgagatcggcctgatgctgctgcgtagcgaggacgaggagctgagaggcattggcgctcagttgttccgttcacctactggtggcgtctctgggtccaacggtaagtttggcgctgtggcttctgacgtgatcgagcgtgagcgtggtcaagatcatgtggctctaaacgccatggtcgatgcccaacaagaagccatgaaggatgtctcggtgaagaccctgcccggtggccgtcaggctcagcgtgagtatgtggatcgccgtatcgctgaggctatcgaagaccctacaggggccaagctggctcagctcactgaggctgagaagaagtacgccaaggttgtcgaggatcactttgtccgcaaagagaactcccttgagaaccctgcgcagtacggcaacatggatgccacttcgatcatgcctcagacccgtcactctggccggtacatcccgaacatctacgatgacgccatcaagctgctcaacctccaacgcttcggcggtcctgagggtttgcagaaggcaatcgttgagagctggatggcttcctatctgagccgtgctgctgtgaaaaccagagtggacaagatgatcaaggagtcgctggagaagaacggcaaggtggcaacacctgaggacatcaagaaggctgtcgtcgagtacgcctacaacaaggcatacggcattagccacacgactgacttcaaccgctcctcgctgatcgacgataacctcgaaggtctggtgggtcaggatgccaacaacttcctcgaaggtcgtcacctgtttgactcggacgtggctgtatcgctgagcgatgggacgaccttctcggttaacgacctgcgcatctttgacgttcctcagatcacctcctcgtacaaccgtcgagtaaatggggacatcgggatcatggctgcaactggtaaggacaccactgccctcaaggacgcgatcctcaagatcaaggccaagaatggcaacactcaggaagtggaagccttgcaggagtccatcaagctactcactgggcgctcacgtcgagaccctgactcagcggctgcaacactggctcgtgccttgactgacgtttcgttcttcaccaagaacgcctacatgggcgctcagaacgtcactgagatcgctgggctgatcactaagggccacactcggatgctcatgaagggagtccccttcctccgtgagatgaccacatggggctccaagatcaaacctgagcaactcaaggagatgcacgacatgatcttcggtcgggagctggatgacctcatccgtcctcgccgtgctgacatcgtgcaacgcctgcgtaaccaaggctacagcggggccacggctcagactgtgggcaccatcaagttcgccactggtgagctggctgcccgttcgcctttcaccaagttcctcactgagacctccaactacatcctcgatgctggtcggcaaggtgtccttgtggacctcgtgaaccatgcgctctctgggaagacctcgaagctgttcaatgaggatcgactgcactcgatgtcgatcaccaaggctcagttcggtgacgtgacgaatgccctcaaggagcatctcgtggctgatcccaaaggtggcttcaagatccgtgatcgggccaagttccaacaagaccctcgggtaatggacatctggcggattggtgacaaggtggccgatgagaccatcctgcgtccccacaagctgagcaacaccgatgccattgcgcagaacgcttgggtcaagttggcgatgcagttcaagaacttcgtcctgcgttcggtaaacagtcgcctcctacggggcttctataacgccaccaagaacaagcaggccatcgaccaagcccaacaagtggcgatctcgatgggtctcgcctcgggcttctatgtggcccagcgctacgtccaagctcaagggatgcctaaagaggaacgccgtgacttcctgtcgcggtcactggacatgaacatgatcgcttatgcagcgggctctcgtagctctcacgttggtgcccctttgggtatcgccaacttcgctctggcccctctggggttcgatgcggccgctgctgtgcggacctctgttcttcctcgtggtcctcagtacaccgaacggaaccgggctgtgaaatattccccgctccgctcctcgggcatccaagacccactctcgaagttcgctgagcaagtacctggcctcggagtcctcgggtcgatctatcagattggcaatggcaccgctggcgtgttccgcgatgagggtcgggctcaggatcaggactacaagtctgcgatctacaacgggttccgtaacctcgtgccgaacgaccccgctactcagaaggtcaccaacatgcttttccaagagatgggcatggagtacggcaagcgcggccagaaggtccgttaataacccctcactattgggatacatcaactcacgccctgccctaacccggtggggctttttcattaaggagaccacatggcaactaccaccaagacggtgaagacgtatgccctcaacggttccctcaaggacttcacgattccattcgagtatctcgctcgtaagttcgtgagtgtcaacttgatcggcgcaacccgtaaagagcttgtactcaacgtagacttccgcttctccactccaaccaccatcaccaccttgcgtggttctggctggggtccggctgacaacttcgacctgatcgagatccgccgttggacttccgccactgagcgtctcgttgactttgctgacggttcgatccttcgggcctacgacctcaacaccgctcagattcaatcgctccacatcgctgaggaagctcgtgacctcacggctgacacaatcggcgtgaacaacgatggtcaactcgatgcccgtgcgcggcgtattgtgaacctcgctgatgcgatcaaccccggtgacgctgtgaccctgcgccaagagcaacaatggggcggctcagcgctcaaccaagcgaacctctcggctgcctctgcggctgcctctcaggcttcccggctggcttctgaaagtgcccgcgatacgtccatcacttacgctggcgaatcgtacacccatcgaattgcctcggagaccgctaagaacgcctcggctgcctctgcgacaaactctgagttgtccaatcagactgcctacaagtgggccaacaaccctgagaacaccgtggtcaataccgggcaatactcggcctaccactgggtccagaaggcaatcgcccatgtggctaccgctctgggctacgccaacgctgcctcatcgtctgccactcaggctgcccaaaaggtgaccgatgctcaggctcaagtgagtctcgctgctgctcaggcgaccatcgcaaccaacaaggccgctgaggctgccacaagcgcttcccagttgggcggtgcgattggtattggcgacaacatctcgtccactgcgagcggtgatgggaactggaaggtggtctttaagggcatcgtacaggctgtcggtgcgttccttgggaagcgctttgaggctgagccttatgatgaggccaacggcttcgccaaccaatgggcgaccactgccccattcatgtccaaagagaaggccctcacgaacgtctcagcgtactacccgattgttaaaggcaagtacagtcaaggtggtgtcggtgagactgcctctatgggcgtccttacgaatacgaacggggttcactcgttgacattccattggggcaactcgggtggtggtggcgctggtgccctcctgcaaatgaccaaagatggggcgattgctcagttctctggtgcgctctactctggtggtgcctccggcatctactcaggcactggtggtgtgtgggatgcaggtaaccgcgtgtggtcaactggtaacttcaacccagcctacaaactgggtggtactggtgggaccacaacgatgggcaacaacaatcaagtctgtggcgtcacctacacgaacctctcggctgccaaccaagtttacaacggtgcctttgagattcgtgagagcggcctcgtaggtaatggtggaccagctccgggtcacatctacaacgcaccgggtatctccttccactggggcgcgaccgttgtttctaagctgatgatgaactctgccggtcacttgtgctggggcaaccctgccgcgcagtacatgcagatctccccggatgggaacatcttcggttccgttttcggtaaccagtgggcgaacacctacatctacaacaccgccaatgagcgtgcaaacgcttgggccgttcaagaagcccgcaacgtcaacaacattggcatcgccatgtccagtctgcgagtcaactcgctgggctgccacatgctggctctggctcacaacaactcgggcgtggagtggaacgaaggtgtcgctggcggcaacctcactggcaccaacactggtggcacttacttcgctggctacaacttggccggtaactacgttcggatgggtaagttggttaacgctgacggcgcatcccctgactccgtgaccctatacatgcgctatgcgtaaggaggattaatggctaacagatctatcgtggacgtgaagaatgtccaatggtgctgccctaacaaggatgcagcctactgcctcgtaaagttctcggacatcgaggactacatcgagtacaccgctgtgcgtggcgacgaagttgcgcatggcaatgaactattccagatcatcgaccgggggctcgctggggacatccctgagtatgccggtcccgaccaatcgcagatcgaggcatggaacctgctcatggaggaggtctctgcgcttcgtgtggagttcgacaagatcatccctgaggtccaattgggcctcgctgcacctgagcgtgtagagcgcgccaagtacctctatggccgcatcaaggacatcgagtcgtaccacaaagcgacctatgacatgacgttctgctacgtcaaccgtgaggtgtcctaatgggcatctctatcgacttcaacaacggggtggtgcaagccactccagtagtaggtgctgctgtaactgacgtgacggcccggttgtttctgggcctttcaccaagtgagtggttctacgcatccgccgttttgtactccctcgtgatgactgtaatcgtggtttacaagaccgttaaagaagaacgccgaaaagacaaggaggctgagaaatgagtgatgacttact

SEQ ID NO: 3 - DNA, 41361 bp, unidentified
  misc_feature 1..11: note = bacteriophages nucleic acid sequence
  source 1..41361: mol_type = genomic DNA
gatcatacgtgtgccaagggtcttaagggtgacgaacgataagcgacacaagggcagaaacaaacgcttgacaacaccgcaacacgctgtagaatacgccacatcaacaacgaaacacgcaacgagctacctgagcagatgtcatgagtatggtgggtcgggtgaggtcaaagtcaccagcatgggtcgcaagaagggcaacgaattggccgataactacggcctaacgggcacccttacgctctttaataactcggactgcaacactacgcactgagacgggatgacgtcttaacgggcttgctcagaccctcggtgcgtagcagtgaaaggaaatacagcaagagggctctcgtgtatctaagcattagcacgggacgtggagagccttcgtctgtatctcttaacacacacaagcaaggagcatcaccatgagtacacgcactgatcgtctacgcactgagctggctgacctcgatgcacgcattgtgcaagctgagaacgaccatcgagccgctaaggttctctttgggcgctttgagggctctgctgctcatcctatgtgggagaagctgcgcaatgaggttgactcaacgctgactcgctgccgtgtccttgaggccgtgtggcaccgcactaaggctgacctgctcgaacaactcaacgctgacaaggagtaacaccatggacactggctaccttcaacatggcaaggcaccgggaccattccgcaccgagaaggtgagcatcaagaacgaacacggtgatcgctggcttgccttctatgagggtcgctggcgtcgggttcactaccaagttcatcgcttgttcatcgtgtacaacggtgagcatattaccatcaccatcgaaggtgtctgagcgattcactgtagggccttccttgagggctctatgggaacaactcaacgtcacaccaacaacctgggagcaatcaccatggcactgactcaactcaaaactgacaccaccgagatcgctggcaagacctacctgacccgtcattggtacatggatggtcgcaaggttccgggctctgagcatcacgagatggacggctccgctgctcatcgcacctactacgctcagttcgtcacaccggctgttctccgggtcgtcaaggcccactttagcaagtcccaatgggctctcatgggtcacgcctatttgaatgatggtgaccattacctcaatgagtcctccaagctgcgccagtgggatcaatgcgacatccgccagatggtgggccgtaccgtcactgagtgctcctacagcgatgctcctaaaggtgtcatgtactggtcgccaagtgagaacacctgcatcaccaaggaagccgcacggatgctcatcgagtccggggagtacctaaaatgagcgtccctaccttccgtcagatgctctaccgggtgatcattgaggaactcaagaaggagggcatcaagttcgggcaagatccacacacgctctcctccagtcaatccaacacgctctatgagtgggctcaagcgatgcgctacaagccatccgctacggcctcgctgtcaccgggtcgccagttctacgtcttcctctcccgtctggagcaagtgcaatgagaatgaccaacgagcaaatcaaggccaagtatccggccaccgctgagcgcatcattggggaacgtcgagtcctccgtaagctgctcactgcgatcactggctctggctactgcttccgcatcaacaacggtgaggacttcgagaccaaccacacctacaccgtgcaagtgggcattgacgcctgcatggctaccgatgaggaccatgtggtggtctaccgggttcgccctgatgacggcacctaccaacgcatcggcaagttctggctggtctatgggaactccgctgaggaggtcatagcagactacagcgccatcacatcgttcgagtccatgttctccagatggttcgacgaagccaccatagacgccgagtgattcactgatgggccttcgctgagggctcattgggaacaactcaacgcaaaccacataggagatccaaatgatccacgcaatcgctcgccagtccaaaaacatctgcctgttcgctctgttcgctaccgtgatcgccctcggggccatccatgcgaatgacgctgaggcacgaggtttctcgggtagtcggtcgagtagctccagctcatcccgctcttacagcgcaccgcgtaccagctcctacaagcctgctcctcgggtcgtccagaacgtcaccgtcaaccgtaccactgtggttcatcaatcggctccagcggccatgggcggtggctctggtggcttcatgagtaccgtagcgggctcctttgcgggcacctctctggcgaactggtggaacaactccagcaacgaggagaaggccgaaaagcaacgccttgaagacgagcagaagcaacgcgatgaggccgctgcactggaacgcctcaagctggacctgctgattcagcaacaatcgggcaagccaatcgagggcatgttgccaccgggcaaataagtacctctctacgatggtcaataagagcctgccttcgcgtcgataacagcgcaaaggtgggcattctgtaccgctccatttaccgcacttcttaggtctttgaattatgcaacgctacaaccgcactaacttcacttcggctgcatttgctgaacgtctcatcgctgctatgcgtggcgctctctctgatggttacgcccactatgtggagaaccggcacgggcaacgctggctccgtgtggacgtaaaacccgacgacttcgggggctacaccttccagttccttgctggttctggtcaagacgttggcagcctgatcttgcaagcctgcttcgtctggtccgaggagcatgagcgagccttctcggggttgttgagcgaattatacacacgttctgagcatcctttgttgaccgctcgtcgtcgtgatgcagaactggaagctgaaagcaagcccaaacctgcgaaaaatcgttggaaatcagcacttaaagagaccctcgggtacttgactgcgcttgcggttggtggtggtgctggacatggcctcgtcgcattgggggtgttcggatgagtaccgttctcactaaggccaccacgggcatcgcatcggttgacaagtaccatccccttctgcgtgagcatcttgagaccctcaaagagatggccgcatacgctgaggacaacggcgggatcaacccgagcaagttctctgattcctcctcgtggcaaaagttccttgacgattgcgtggtctgccatgcaccggggatctactcggtcgcctacctgcatccgggctactgccgcgacatcaagcacgagatgagcaagttcgtcttcgagcccaaccttgaggaaccccttgaggcgcagattcctgaggtgaccttgcaggacgaacacaaggtgctgttcgaggtcttccggtccttctgggctgacgctgggatcgcctacgccaaggtgctgttcaaccttgagcctgagaacctgaccagtgtacaggctgcccgctatgagccctcagagactccacgaggccactggcacaccgaccgggactctgacgtcactctggtagtggcgctcaacgatgaccatgtagggggcggcacgatggctgctcaagggcctttcttccctgacgtgatggtccctcagaacgaacccggctggggcatgttcttcaagggtaaaacgaccctgcactatggtctgcctgtcaccgaaggctgccgacaactactggtccactggagtgaagttaagtgatgcacacgaattaccagcctcgaaagccggggctcattgaccaacaaatcatcacctcaaagaacaccgttcgcaccgggaaggacgcctttggctactggtacggacgccgcaaggacttcactgaggcgttcctgagtgccatggaagctcgccaagtggtgggcggtatgttgtgccccggcctgcgctacagcgatcaaggcgacttcactcgctgctaccggggaggcttctgagatgcgtggcttcccaaaacgcccgtccatgctggaactgccaccgtccgactacacccagcgcgccaagctcatcaagttccgcgcctcttgggtcgatccgaacacctacgggctcgtcaaggccaaagagctgacctttgagctgggccttgggccttgtggtcgtcacgttgtcagcctgggagttgccatcactgatgacctactgacgatcaagcagtggtcacgaagccctgagctgctcaatgagcctcaatgcgatgccaagtggaagctggagcggcaccagcgcttagagcgaacctaccggcctgctgtgaccctcaagcggcaagagctgcgagtcaccgggatgctctggtggcgtaaagaggaatgggtcgatgtcattgagaccacccatggtgatgcggtcaagcctgagggtctccttgaggactccgaagtggccgaactacgagaccagatcagcaagtattactccgctatcacgaagtggaacgatgatctcgaactcaagacatttgtctacaagatggccgacgttcatggccggatcgaggtggttaagtaaggctggattaataaaccctcactgttgcgagacacctcagagggttcctgcctaaaagatcaccttaaagacatcttaaagatccctctgagataaaccttatagagcaattctataagacaactatatctcatagagcatcttaaagaatgatccccgagcgtcacgacttcgctgacatcgcaacatcctcattcgccttcaatcaactctccagcatctacggccccgaactggccgctgagcaactgcgcttggaacacgaagcgtacacgcttggagaggaacgctttcatcgccagatggagcgccagatggagcgcggtgagttctccaacaacatcgccgctcagccgctgctgggcactctggtccctaagatgtccgctgcgatcaccgcatggatcgaccaccaagccaacaagggtcgtggtcgtaaacatgtgagcttcgccgctgcacagcaaatgaacccggacacgatggccgctgtgaccatccgctacgttctcaacatgatcgcccagcgccgtaatggtgccccaacggtgaccgagatgagcatcgtggtcggtggagccctcgaagacgaagcgcgctttggccgcatccgagtccttgaggctgaacacttcaagcgagccatcgccccggctctcgccaagcgcaacggtatgacctacaagaaggcgtacatggagcgggtcgaggagtcgatgctacagaagggcgaactggcccaaccatgggttgactggaacgtcgctgactcagatgtccgcttccacatgggcatccgaatgctggagctgttgatcgaatcgacccaactgatcgaggttcgccgtgatcacgctggggacaagaagaacgatggcgagtatgtgttcctcaaggatgaatgggctgacaagatccagaaccgggccttcgcactggccggtatcacgcctcagtaccaaccctgcatcgttccgcctaaaccgtggaagggtctgcaaggtggcggttactgggccaagggtcgcaagcctctgaccttcatccgactcaacggcaagcaagcccgagagcgctaccgggatgtcgagatgcctgcggtttaccgggcagtcaacatcgcacaatcaaccgcttgggcagtcaataagcgcgtccttgaggtcgccaatgcggtgatggagtggaagaacgtacagatcaaggagttccccacaacggaacgccaagagctgccactaaaaccccacgacatcgacaccaacccagacgctctcaaggcgtggaagaaggaggccgctggggtctaccgtaaggacgccgcaagggtgtcccgtcgattggcctacgagttcggactggagcaagccaacaagtttgctgagtacgatgcgatctacttcccgtacaacctcgattggcgtggccgggtctacgcggtccctgccttcaaccctcagtctaacgacatgaccaaagggatcttgcaggctgcccatggggaacctgtaggtgaggaaggaatcgagtggctcatgattcacggggccaacactgcgggcgtcgataaggtgccctttcctgaacgtaaacaatgggtccgagaccatgaagaacttatcttggcgattgccaacgatcccctcaacgtcaccgaatggatgtccatggactccccattctgcttcctcgctttctgctttgagtgggctggcgttaaagctaatggcgctgcacacgtcagtgccctaccccttgcgttcgatggttcctgttctggcatccagcacttttccgcgatgcttcgagatgaacgtggtgggcgtgctgtcaacctcatcccttcggactccgttcaagacatctacaagatcgtctctgatgaagtcgagatcgctctgcaatatgacctcaagtacgggacggacgactggatcgaaactctcgtcgatgaggtcactggagagatccgcgatgttaagcgtctcggcactaagaccctcgccattgcgtggctcacttacgggatgtctcgtaaggtcaccaagcggtctgtaatgacgctggcctacgggtcgaaagcctacgggttcgctgatcaagtccgagaggacatcgtaaagaaggccatcgacaacgatgagggccacatgttcacaagccccggtgaagcgagccgctacatggctggcaaaatctgggactcggtgagtgttgttgtggtcgccgctgtggaagcaatgaactggctacagaaggccgccaagctgctggcctctgaggtcaagtgcaagaagaccaaagagatcctcaagcctgccatgcccgtctactggacgacccctgatgggttcccggtatggcagcaatacacgatcaacccaacgcgccgaatcgacctcatgttcctcggggacgttcgcatccaagccaccgtgatgatgcgcgacaacgggtccagcaagatcaacgcaaggaagcaagagtcgggtatctctccgaactttgttcacagccaagacggctcgcaccttcgcaagacagtcgtacacggttacgacaaccacgggattcgattcttcgccctgatccacgactcgttcggcaccatccctgccaaagctggcgcgatgttccgggcggtccgagagaccatggtcgaaacctacgagaacaacaacgtgctggctgacttccgtgagcaattcatggagcaactacacgagagccaactggacaagatgcctgagcttccaaagatgggaacgctcaacatccgcgacatcctcaaatccgacttcgccttcgcataaggaaaccaattatgaacgccgctcagaacttcgttaagaccaccaaacgtaccctgcgtgatgactccgagatggaagccatccgcaccaagaagggcaagcgcaacaagcccgtccgtggtggtcgcgtagagtggaccccaatctgcaccggcaacgctgcctactaattcccaaccttaggagatcccaatgcaagttatcgttaccgccacctcgtccaaagttgacgacctgatcctgatcgaaacctccaccaccatcggtgacgttacgaccaccgccaagactggctatgacgttcaagagctgatggacaaccgctttctcagtggtgaccttgagactcgcatcgaagcccttcgggtcggtgccgaggctgtgaccatccgctccgttgaggcgcactttaagaccctgatgaacatccttaagaagcccgctgaggtgactgacgtgagcgcggtcccttcgagccaactgcaaggcgtaaaggctgacgtgatgatcgtcgatgaggcccaggctgaacctgtgactgagccggtgaagaaaacccgcgctcctcgcaagcctaaaaccaccactaccgaatccaactaaggggaaccccatgtccaaagtcgaagccgttatcctgaacaccaagccattccgcccaaccgactacaacgagaaggctgtcgaggctgttctggatgagtcctacctgatcgctgatgtcaagaaggacggcgttcgtttgaacctgtgcgtgaacctgatcgagaccaagcatgaccacggttgggaagtcgagtggttgtcccgtgagggcaagcgcttcccggcctttgggccatctcatggtcctctggacaccgaccctcgctgggctgacttcttcaacgagaacaaaggcgaggggatgttccctcaagggttcatgttggacgctgagctggtcctgaccgacatggatggccgtgaggttccctgcaagaccacctcgggcaccctgcgccgtaaagaggagtcgatcccgctgagccgcatccgggtctacgtcttcgacatcgtaccaatggacgttgtgctgagcggtgaggaatacgaggtcttccagtgcgtccgtaagatccacgttgagtatcaggtagccaagctcaaggaatacttcccagagatccaatggatcgtcgctgagtcctacgaggtcttctcggtggagaccatgccagtggttgagcgcgaaggcttcgacgaggaaggcaacgagatcaccgtcaagctccaaccgccactctcgctggtccagctctacacctcggtgcgtgagcgtaaggaggagggtctggtggtcaaagatccgatgggcttctatcgccgctcgaagtgcaacggctggtggaagaaggtgccgagcaacaacgaggacggcaaggtggttggtctggtctggggctcgaagggtaaagccaacgagggcaaggtgatcggcttcgaggttcaactggagtccggccatgtggtcaacgcctgcaagatcagcaaggcccagatggaggagttcaccaaggctgtccttgagggcgctcctaactgccaatgctgtgacgatgactactacgccgctggtggctgctatgcgaaccacacggtgcgagtgacctgcatggaacgctaccctgatgggtcgatgcgtcacccgagcttcgacgagttccgtggtatcagtgaccctctcatcaaagagtaactaaacgagcctcatcgacttcggtcggtggggtttttttgtgcctgtctgaataggagaaatctatgacccagttcatcatgatagttttcgttgtgatcaccttcgccatccttatagctggcttcgagcctgaccggactcccatggagcgcctctacgacgacgaggattaataaaccctcactgttgcgagacacccaaccaaccaccgaaaggagatccaaacgatgcccgttaaagaccgttcgttcgcctaccgtctgcaccaatcgaacatcgaccgtcaacgcaactgcgcccggttcaacatccgtccacctaaaccaccagcgccaaaggccgacttctggcagcgcaccaagacgttcttcaagaacctctggaccaagatcaaggagatcgtcaatgactgacatcatcgccctgacttctgagcgtggtcgtagcggcaaagacaccctgtgcgagttgctcgccatcgaaggttaccgggtctaccgggtcgcctttggggatgtcctcaagaagcaatgcagccacatgctggccctcgacgaatgccaacgcatcgttatggagagccacatgcacaccgacttcaaggacgctcagttcgaggagttggcaatcgaggcgatccctgagagcgagtacaaggactggctgctgaatgagccccagatcctcgacatcgagatcccaaggacacctcgctggcacctccagcaatacggcaccggcttccgtcgcaactacaagcagaacccggacgtgtggctgctggagggtctcaaggagatcaagaaggctcccaaggatgccctcgtggtcgtcactgacatgcgtcaagccaacgaatatgcagcactgagcatccgccaagcgcacctcgttcgtctctcccgagactgggcgatccctgctgtggatgaccagccgctacatgctactgacattgaactgcgtgacttccaaatggacgccgttgtggtgaacaagtggggccacgcctcggagatgatcgaccaactcagaactcaaggagtaattactcatgcctaagcaagaccagaaaatgaagaagttcctcgtcaccgtggagtaccgcaaggaggtccaagaggtgccaatgtatggccgcaccattgaggaagcgctcgaagctgctgaccttgagtacggtgaggacaacgttcgtcgcattcgcccggaggtcactcaatgaacctggcccaaggcaacacccgctcgatgcctgatggcttcctccacatccagaacttcaccgtgaccaagcacgcggggatggctggcgtggtctacatccacatccttgacgcccatcaacgtcagttggtcgaagggctgctcattgagcgcgccatcgtgaccgctgagctggaaggcaaggagctgcaccacttcaaacacggctgctggcggttctccaaggagttcctcaagaacaacttccgtgaggtcgtccatgcgatgaccaaggtgacgctgatcccggtcattgagaccttcaagcagaccctgttcaccgagcgtgaatccctctcgtactgaataaaccctcactgttgcgagacacctaccttcccactttcataggagataatcccgatggcaaaatccaccaagcagttcttctttactccgaaaggcgtagctgaaccttactgctcgatccaaaagccggactacggcaacccagagaaaggcttcggcaaccctcgtggcgtctataaggtcaacctgaccgtgagccgtgctgatgcccagccaatcatcgaccgcatcgttcgtatgcaggaacaaagctacgcggcaatctgcgaggacttcgagaagaaccgcgcatcgctgaccgccaagctggcccgtggtaagaaactgctggaaccctatgagggcgacctgccgttcttcgagaacgacgatggcaccgtgacgttcaagttctccagctacgcctcgtaccaagacaaggaaaccaaagagaccaagccgctgaccttgaaggtcgtggacgccaagggcaagcgcatcgacgctgttcctgcgatctctggtggttccgagttgaaggtccgcttctccatgttcgcctacaccttcggtgccgttgtcggtgcctcggtcaagctgcaactggatagcgtgatgctgatcaaactggtcgagtacgctgctggcaatgacgactgggctgacgaaaccgaagaaggctacgtcgctccagagcgtgaagaaagctgggacgatcatgaagaccaaggccacgctggcgaggtcattcctgacgctgcctcggacttctgatggctggctacgctggcccgaagggcgctcgtacaggcgcttttcgatccggccttgaagaccgcaacgcggctcacatggacaagctcggagtccctttcgacttcgagcagtaccacattaagtacgtcgttccggcccgtgaggccaagtacacacctgacttcgttctgcgtaacgggatcatcgtggagaccaaagggatatgggaagtggacgaccggaaaaagcatctgctgatccgtgagcaataccctgacctcgacatccgtctggtcttctcgaactccaagagcaagatctataagggctccccaacgagctacgccgacttctgcacgaagcacgggatcatgttcgcagacaaactcattcctaaagcatggctacaggagaaacgtaaggagatcccagcggggatactccatccgaaaggaggtaaatgatgccaaaggctgctttcaagaaacgcccaagtacgaccctgctcgtggtccattgtgcggcaaccaaaccgaccatggacatcggcgttcgagagatccgccagtggcatgttcaacaaggctggctggacgttggctatcacttcgtcattcgccgtaacggcactgtcgaggatggtcgccctcatgacgtcattgggtcacatgccaagggctacaactccacctcgctgggcatctgcctcgttggtgggatcaacgccaagggcgccccagagaacaacttcacgcctgagcaattcaactcgctcaagctgctgctgatcactcacaagcgcacctatccgcaagccaagatcgtgggtcaccgcgacctcgactcgggtaaagcctgcccgtccttcgacgtggccgagtggctgaaaactcaagggatttaataaaccctcactgttgcgacacggcctcactgacttcggttggtggggctttgttgtttttaaacgttgactttaggaggtcattatgaatcgttccttactgcaaggtgggttcgacctttgtgagcatctcattgaccgtggcatcggcgcgattatcgctggtggctgtgcccgtgacctgttcttctcggttgagcctaaagacatcgacatcatttgcgcgggcaccgacccggagactgtttccagagcgctcgatgaaggtggctacacctaccacaagttccccaagtaccacaccggctccgactctgatcggctgcaaggtgtctggaaaatcgaaggctgcgagatcgacgtgattctttacgaggtcgagtgcgtcaccgaggccatccagaagttcgactacaacctcaatcagttcgccatctcgggcatccaaaggggcatcgaaggggcaaccattcgcttcatgggcgctcacgcttggaccaatctggttcaactgcgagaggacgctcgtggctcccgtgctgaaaagatggaagccaagtggctggacctgatccacaaggcaccgatgcgtgatggacgttacgtcgatgagatcgaggtggccgatgtcgtcgcatgaggaacgcgaagaaagcgttttccttgcgcatatcccgtgtgaggaatgtgggtcgtcggacgcaaactcgctgttctctgatggtcaccaatactgctttgcgtgtccccctgagactgcctacaaggcacccgatgggaaggagcgtggggagttcacaccgaggctcaaagctgatggcacgctctcgatgggcgaggctggaggctacttctcggcgctccctaagaggttcctacaggagccaatctgccgcctctatggttactggatcggcaaggcgttctcgcctcacgagggcaaggaagtcccggtacagatagccaactactacgacaccgagggcaacctcaagtcgcagaagtgccgtcaagccaacaaggacttcttcaccaagggcaagcacgacaaggacgctctgttcggtcggcacctgtggaacggtggtcgtaagatcgtcgtcaccgagggtgagatcgactgcctgacggtggcccagatccaaggtggtaagtatccggtcgtgtccattgggcatggctcgaaggctgccaaggcgacctgtgcggccaactacgcctacttcgatcagttcgacgagatcatcctcatgttcgacatggatgagcccggacggattgcctcaagggaagccgctgaggttctcccaccgggcaaggtcaagatcgcagtcctgcctttcaaagacccgaacgagtgtctccagaactcccaggccaaagctgtgatggacgccatgtggaacgctgccccattcgtaccggatggagtggtctctgcgaagtccctcaaggcccgcatcaaggagaagaaagcagtcccgagttatccactcgtggctccttacgaactccgcaagatgaccaaggacatccgcgaaggcgaggtcgttctggtcacctctgggtcaggctcaggcaagtccaccttcgttcgccagaacacttacaacctgttcaatgactgcgggattcccgtaggcgtggcgatgctggaggaggccgttgaggaaaccgtacaggacatcgtaggactccacatgggatcacgagttcgtcagaaccccgatgagaccaccgaggagatgtttgacaaggcgttcgatgagatcttcgagagcgacaagctgcacctctacgacgccttcgctgagtccgctgaggatcgcctattggcacgactggcgtacatggtcgaagtcaacggctgcaaggtgatcgtactggaccacatctcaatcgtggtctctgcgatggacggtgagaacgatgaacgcaagatgatcgaccggctcatgaccaagctcaagagcttcgccaagaccaagaacgttgtcgtcttcgttatctgtcacttgaagaacccggacaaaggcaaacctcatgaggaaggccgacctgtcaccgctaccgacctgcgtgggtccggtggtctgcgccaactgagcgacaccatcatcgctgtagagcgaaaccaacaaggtgccaaccctaacctcatcctgttccgactcctcaagtgtcgattcacgggcgagacgggcgtggctggctacatggaatacgacaagcggactggtcgattggtagcgaagcctgagggctggcgacctgaccaagatgcaactgacgccgctgatgctgcatgggcagaccagcaagaacccgacttttaaaggagaaccaaaccatgaagaacttcgacctcgtaactttcctgatcactctggctggccgcattcaagagaagcgtcacgctcgtttggtggctcgtgaagcgtccttgaaggctgccattacggctgctcaaaacgccctgcaaaccaccgtcgatcaacgtgtgcaagccaaatggaagcacgaagacatcaagcgcgtgagctgatccaagggcctctctttgaggggccttttagtgagttcacacatcaatgctacaggggggaatacacatgaatggttctgacgttcgcaagttcatcaaacgtggtgagcaggccgctgaggtactcgaaaagctgggctactcgtacatcgagaaggctgggcatcacccacattgggaagctccagtaaacccgatggacccaatccttgaggcgctcaacaagatgatcgctgagaaggttgacgctgacatcaaggcccgcattaaggacgacccaaggggtccgaactggcacctcgttgcgccaatggtgggcaaggacttccgggtccagtgcgccaagatcccggccaatagccaactggcgtcattcgcctttggtcctcacttcgctggcaagttgttccgcgccatcgagatccgctatcaccgctccgaggagtacaccggctatgccgtgctgttccacttcaacgtgcgcccgtatcgcccagaagtcgtatggctgcctttgagcgctgtcgccttctccaactaaggagggcctcatgctcatctctgacatcgaaacgaacgggctctatgagtccgtcactcggttccactgcgccactattcaggactatttcaccgggcaatatgttcggtacaacgagtccaccttcaaggagtacatcgctgcccttgaggccgaagctgccaagcctgacggtatgatcgttgggcacaacttcatcaagtacgacatcccggtcctcgacaagctcaagcgtctctacttcggtaagcgtttgaacatcccaaggaagcgcgtgatggacaccctcgtgatgacccgtctggtttactccaacgttggtgatcgtgactcgggtctcatgcgttcgggcatccttcccggcaagatgtttggctctcactcccttgaggcgtggggctatcgtctgggcgagatgaagggtgaatacaagcacgacttcaaggtccagcttgagaacgatggtggcgtctacgttgacggtatggagtggctggaatgctccgagtccatggaggactactgtgagcaggacgttcgggttacctcgaagttgttccgcaagatcatctccgacctgcactacttcaacgatcaaggcgaggccattgaggccatccgattggaacatgcggctgcgtggtcgctggcccagatggaacgcaatggcttccccttcgacatcgagggggctgagaagctctattgtgagctggcgggtcgtcgtagcgatctcctcgtggaactcatccagaccttcgggtcgtggtggtctccgaaaggtggtaagtcgcagttcctcaacccgaagactggcgcaccaatcgactactggtcggatggccgtgtcatgccgaaggtggtctatcccaagatcggtggcgtgttcctcaagagcggcaagaaggacacccgagagaccttcgagggctgcccttacacgccaatcgaactggtcacgttcaaccccggatctcgggcgcaccttgagaaagttctacgtgatgctggctgggttccgaccgagctgaccaacacgggcgctgccaagatggacgatgagacccttgagttcgtccgtgtggctgaccctaagaagcaagcgtgcatcaaccttgtgcgtgagttcatggaggtcaccaaggtcattgggatgctctctgagggcgacaaagcgtggctgcgatacgtccgtgaggatggctgcattcatggctcagtgaaccccaacggggctgtaacaggccgtgcgacccatagccacccgaacatgggtcaagtgcccagcgccaagaagaagtacggacctgcgtgccgtgcgctctttggggcggtctttgcgaggaagctcaagaagggctgggagaacgccgtccagttagggactgacgcctctggccttgagctgcgctgtctgggtcacttcggtgcgccattcgacgaaggctcgtatgccgagaccgtgttgaacggtgacatccactgggtcaatgcgctcgctgctggtatcgctcctcctggcctaatccgtgacaaagagaaccatgaacatgacgcctaccgggacaccgcgaagacgttcatctatgcgttcctatatggcgctggtgatggtctcgttgggtcgttcgttggtggtggcaagaaggaaggcaaggcactcaagaaggcgttcatggagaacaccccggccatctctggcctgaggggagcccttgaggagcaactgatctccgagcagaagtacaacaacgtcaccaagaagtacgacatcaaatggaagcgccgttggatcaaaggtctcgatggccgaaagatccatgtccgctcccctcactccgcgctcaactcgctgctccagtccgctggtgcgcttgtgtgcaagaagtgggttgttgaggtggaacgcattctcgtcgaggagcatggccttgttcatggctggtacgacgacgatggcaaccccggtgacttctgcttcatggcatgggttcacgacgaactccagattgcctgccgcaaccaagaaatcgctgagctggtcgcaaaggtctccaacgaggccatccgactggtaggcgaatcattcaaattccgctgcccactggctaccgattccaagatcggcccaacgtggcgcgagtgtcactaaggagatccttatgagcatgactctgaaactgaacgtgtccttcccgatgaccatcgtggtaaagaccgagaccctgaaagccttcgacgaaacccgtgaggaggcccgtaagatccccgctgaggagatcgccaagctcaagggtgaaaccaagttccgcgctgagctgttccgtggtgaccgtaccactgagcaagtgatggagctgatctaccgtgctggcatccgtgagctgatccgcaaggaactggtcgaggaaatcaccggcaacgaatcgaccgcccgactgggctgcatcaaggtgacctatgaggccccacctaagcgttcctgtcagggctgcattgagaccaactgcgtgctggccgagcggaacactaacgctggctgcgacaacaagcgcactggcatccgtgagcccggtcctcgttggactgagacggtatgaatgagtacctaaaggttctctgggaaatcaaaaagcaagcgaggtcgtatcaaagcgacttcgttcgttcccgcattgcgctggtcaacgaggcttcatcccgaggccacatctcgtgcctatcaactgccggtaagaacatgggtctctggaccttgaccacttccggccaagacttcctcgcacaatatggaggtgccgtttgagtaaactgaaagtgggcctcgcccatgatatggactacctcatcttctcagcgatgtccgctgctgaggaggagcaggactggggcgaagacgtatggaccctgttctgcgatcacaagaaagcccgtgacattctgttcggcaccatcaagaccatcaaggcgaacatcgccgcacaactcaagcgcaagttcaagctcactgaggacaagtacgagtttgttgacatctgcatcctgagcggtgacgacaactggcgtaaggatgtccttgagacctacaaggccaaccgtaagggcaagcgtaagcctgtgggctaccgcaagttctgcgatgagatcatggcgcactacggtgacatgtccctcaagtggcacggtgtcgaaggtgacgatgtttgtggcgtcctgatgactgacccgagcatcgttaagtgtgaccgtgtgatcggcgtgagctgtgacaaggacttcaacacggtgccgggatacttcttctggctgaccgagcaggaactcatcaagaacgatgaggcaacctcggacctgcaccacttctatcagaccctcaagggcgacaccacggatggttatggtggcgtaccgggagtcggtggcgagttcgatggtggcctgatggattggctccagtctccgaagttctacttccaagacgtgaaggtcatgaagtccggcaaacgcaaaggcgaggaggtcccgttctggacttcccgtgagcctgatggcgagtccctctgggactgcatggtgtcgctcgctgccaagcagggaatgactgaggaggagctggtggtccaagcccaagtggctcgcatctgccgcgcttcggacttcgatatggagaccatgaagccaatcctctggcgtccctaatttaccctcactattgcgagagggagcccagtgttcccttaaggagtcctattgctcaagcagatccaacactacatccaaaacccggatgacatccctgacatctctcccgcatctgccgactatctcaacgtccgtctcaacgcttcctatctgatctccactggtgctgtcgatgatctccgcaaagcggggttctccgagcagtacatcatgggcttcattgacggatgccatggggcgactgagatcgtggagctgatgcaggaggctcaactaaacaaggaggaatgaccatgtgttttaaatccaaggtcaagaccccaaagaccaaccctgatgctgtgaaagcgcctgagccggttctcattgaggaacctaaaggcgtggacttcggctcaaccgaggacgatgacacctccagcgatgagggtctcgatggtctcaaggtcaagaagtccgatgtttccacaaaggacactggcgatggttcgtctgatgctgtcgctgctgatactggcaccgggaccatcaagaagtccaagcctgctgcatccatcaagaaggctctcaagaaggtcactaagtgaacctggctgcgcatgtccagaaggaaggtcacccggcctgcttccgtgaggtgctgagcgacatccttgaggaactcactgagctgacgtggggcgggtccagagtcgaatgctacgagcgtatctgccggtcaaccgaagaacttgacgaacgtatagagatcaccgtgagagacccgcaagggaagctcgtggggttcgctgtggtcgtcaatgatgaggatgaccatgtaggtgagtgcctcggaacgcaatggcactgggttcacccggaccaccgtggccccgtgggtcgaatgatccttcgggcaatcgttaggctggcctccaatgctggctacaagaccgtggcgtacacgaagcgcttaggcgtgggtcgctacgagatcaattacaaacaactgaaggagaacatccatgggcaagaaaattaagaaggtcgtcaagaaggtcaccaaggctgtcgttaaagtcgctgacccggctggcgttatcaaggaagcaactggaggtaacgacgcacctgctcaggtagtcgaggcccctgccgcaccgacccctgtggctgcccctgcgcctgtctcagcggctgtcgttgaggccccgaaggataccactgagggctctgatgatgctgacaccgaggctgccaagaaggctgcccgtgcgcgtggtaaacgtggtctgagcgtggctcgttccgctggtactggcatcaacatctaaccaaggaggtgacccgtggcgactacaactcgcaccgggctcgctgaggagggcgcaaaggctgtttacgaacggctgaaaaacgaccgagttccctacgagacccgtgctgaaaactgcgcgaaggtcaccatcccctcgctgttccctaaagactccgacaacgcctctactgactactccactccgtggcaagcagtgggcgctcgtgggctcaacaacctgtctgccaaggtcatgctggctctattcccgctgcaaagctggatgaagctcaaggtgtctgagtggcaagcgaagcaactggtctccgacccttcgcaactggctgtcgtggaacaaggcttgggcatggttgagcgaatcctgatgtcctacatggaagccaactcgtaccgtgtgacgctctttgagctgatccgtcagttggcccttgcagggtccgctctgatctacctgccaccaccagacgcatcgtcgtctgcgtacaacccgatgaagctctacacgctccacaaccatgtggtccagcgtgatgccttcgggaacgtcttacagatcgtcaccgtggataaggtcgcctttgcggctctccctgaggacgttcgcaactctcttggcgctgatggtgagcgcaagcctgaccaagagatcgaggtctacacccatgtttatctggacgatgagtctggtgagttcgcttcttatcaggaagtggatggtgtcgaagtagatgggtccgaaggtcagtatcctctggatgcctgcccgtggatcgctgtgcgctggaccaaacgtgatggcgagcattatggccgctctcatgtcgaggaatacctcggtgacctgaactcccttgagtctctccatgaggccatgatcaagttctcgatggtcgcctcgaaggtgatcggactggtgaaccctaacggtgtcactcaggttcgtcgtttggtgaaggctcagactggtgactttgttgccggtaagaagtccgacatcgagttcctccaactggagaagaccgctgacttcacagtcgctaagtctgtcgctgacgccattgagcaacgcctctcctacgtcttcatgttgaactctgcggtacaacgcaagggcgaacgtgtgactgccgaggagatccgctatgtggcgagtgaacttgaggacacccttgggggcgtctattcgattctctctcaggaactccagctaccaatcgtccgcatcctgttgaaccaactacaggcaacctcgcagatcccagacatgccgaaggaggccgttgagccgactgtcagcactggtgtcgaggcactgggtcgtggtcaggacttggacaagctcaatcagttcttgagcgcaatggctaacgtgagtcagctacaggctgatccagacctcaacatgagcaacatcaagttgagactggcgaacgctataggcatcgacacgtccggtctgctgctcactgaggccgagaaggctcagctccaatcccaagagatgctcaagcaaggtggcctcaacgctgctgctggcatcggtcagggtctcgctcaacaagcgaccgcaagtccagaggccatccaaggcgctatggaaactacgggcatcgaagcggccccgatttaataaaccctcactattgcgagacacacgttctgccaagcaagtacatctgggaaacctcggatagtgcccgaggcgtgtgtctctccattttctaaaggagacccaatgagcaacgaatcccaagctgacgtctatgcacacttcggcgtgaatagcgctgtgatgaccactaccaacatcaccgagcatgagcaagcgatgctggcaatgcccgtgtctgttcgtgatggcgatgactccatcgagatgcactacgaggacgccgaagaaggctccaacgagctgcaactggataccggcgaggacaactctcaagagctggaattgacgaacgaggagggcactgacgaaggtgctgactccgatgagttcgtccctctgggcgaacctgacgctgacctgatcgaagcctctgaggccgtcgatgagtacgctgatggcttcactcagatgcgcgctcaagcgatcaaagcgggcctgccacaagaggtcgctgaccagatcgaggccgagtatgaagctgacaacaaactctctgaggcgtccttaaaggcgctggagaaggttggctacagccgtggcttcgtgaagtcgtttatcagcggtcaagaagcactggctcaaacctatgtggcccagatccagcaatacgctggtggtcccgagaagttcaaagccatcgtggctcacatgacggccaactcccctgatgctgttgaggcattggagcgagccatccagaaccaagaccttgcgtccatcaagacgctgatcaatctgggcatggcgagccgcaccaagaagttcggcaagacaccagaacgtagcgtcactaagcgtgcccctgcaagtggtcctaaacaggcccctcagggtccacaaggctatgcgtctcaggccgagatggtaaaggcgatgggggactcccgttacgctaccgacccatcttaccgtgcccaagtcgaagcccgagtgctgcgcaccaactggtaattaataaaccctcactattgcgagagatacctatccgattcccttcggaggatctcttgcgcccttaagaatttcacaaaggagaactaatacatggcgaacatgaatggcggtcaacaactcggcgcgaaccaaggcaaaggccagaaccctgctgacaaactggcgaacttccttaagctgttcggtggtgaagtcctgacggctttcgtccgtcgctccgtgaccatggacaagcatatggttcgtaccatccagaatggtaagtccgcttcgttccctgttatgggtcgtaccaaaggttactacctcgctgctggtgagaacctggacgacaagcgtaaagacatcaagcactccgagaaagtgatccagatcgacggtctgttgacctcggacgttctgatctacgacatcgaagacgcgatgaaccactacgatgtccgtgctgaatactcggcacaactgggcgaagctctggctctggccgctgacggtgctgtactggccgagatggcgaacctgtgcaacctgcctgccgctaccaacgagaacatcgccggtctgggcactgccgttgttctgaacatcggtgctgctgctgacctcgttgacgttgaggctcgtggtaaagcgatcctgaaaggtctgactctggcccgtggccgcttcaccaagaactacgtccctgctggcgaccgtcgcttcttcacttcccctgacgactacagcgcgatcctgtctgctctgatgccgaacgctgccaactactcggcactgatcgacccagagaccggcaacatccgcaacgtgatgggctgggaagttatcgaagtcccacatctggtcgctggcggtgctggtgatgacgacctcggcactaaccagaagcacgccttcccggccactgctgctggcgatgtcaaggtagctcagaacaacgtgatcggcttgctggttcaccgttcggctgtcggcaccgtgaagctgaaagacatggcgctggaacgcgctcgtcgtcctgagtaccaagctgaccagatcatcggcaagtacgcgatgggtcacggtggcctgcgtcctgaggctgctggtgcgctggtcttcaccccggcctaaagccaactaaccccttggggctcctaaccgggctccttggggttttttttcattcaacgaaaggagatcaacatggcctatgaatcggtcctcgactctgatgacgaactcgatgctgtcaatgacatgctcgctgccatcggtgagtcccctgtaagttccctcgaaggtgaccctaacgctgacgtagcgaactgccgtcgcattctctccaaggtcaaccgtgagatccaagcgaagggctggacgttcaacattgaggagggcgcgatccttctccctgacgccttctcgaagctcatcgagtacctgcctgactacctgcgcatgaccacctcaggcggcaccctgtacatcaaccgtggtggcttcgtttacgaccgcaccgcgaagactgatgtctttgaaaacccaatcaccgtggacctgatccgcctcaagcaactctctgagatgcccgagtgtttccgctcgtacatcgtcgctaagtcctctcgtcgattccaaacccggttcttcggtgctggtgagatcgagggctccttgcaggaacaagaggctgaggcttgggcgtccatccaagagtacgagctggacttcggtggcttcaacatgatcacaggcgatgcgttcgtcggtggtatcaccaaccgctaaggagggcctatgggactcgtttcgcaaagcgtcaagaacctcaaaggaggtatctcgcagcaaccggacatcttgcgtttctccaaccaaggtgccatgcaaatcaatggctggtcctcggagactcagggtctacagaagcgaccaccgaccaagatcatcaagcgtctgtacagcactggcgcactgggcgtgaagcctctggtccacatgatcaaccgggactccaccgagcaatacttcgtgtcgttcttcgggtccggccttacggttcacgacttggctggcaatgagtatctggtccgtggttacaacggctacgccaactgtgcgaaccctcgggatgacctgaggttgatcaccgtggccgactacaccttcgtgaccaaccgtaagactgtcactcagttgggcggtacgctgactggtgctggacaacctaacgtgaccactcgtgggcttgtgaacatccgtggtgggcagtatggccggaccatgcagatcctcatcaacgggggcgtctacgggaacatccagatgcctaacggttccgctgagaaggtgcctgctgggcagccttacgctggcatgaaccaagtggacatgacggacgccaactggatcgcctcaacgatggccgctcagatcaacactgcgctcaacgcctcgggctggtcggcaacctctggccccggctgggtcatgatcaccgctcccggccccggtgggtttgtttcactccagaccaaggatggctacggtgaccagctcatgaacggcttcatctaccaagtccagacgttcaacaagttgcccgctcaggcccctgatggatacctcgtggaagtcactggcgagtccgctcgcacaggtgacaactactgggtccaatacagcctcgctggtaaggtctggaaggaagtggcgaagccggggatcatcgctgggttcaatagtgcgaccatgcctcacgccctcatccgggccgctgatggcaactttgattggaccccgctgacatgggatacgcgccagtgtggtgacgatggaaccaacccaatgccgtcattcattggtgatcgcatcaacgacatcttcttcttccgtaaccgtctgggcttcattgcaggcgagaacgtgatcatgtcgaggaccgctaaatacttcaacttcttcccggcctccgtgagcgctcttagcgatgacgacccgattgacgtagcgatctcgcacaaccgtgtgagcatcttgaagtatgccgttccgttcgctgagcaattgctgttgtggtcggaccaagcccagttcgtattgtcgtccgctggggttctctcctcgaagaccattgagttggacttgacgactgagttcgatgtctctgatggtgcccgtcccttcgggattggtcgcggggtttacttcgctgcacctcgggcctcctacacgtccctcaagcgctactacgcgatccaagacgtgagcaacgtgaagtccgctgaggatgtctccgcacacgttccgagctacctgccaaacaccgtgttcaatctggccgggtcaggaaccgagaacttcgtgtcgatgatcagtaacgggcaaccgggcaacctgtacatctacaagttcctgtacctcgacgagatcctccagcaacaatcgttctcccactggaacttcgggaccaacgttaagatcctcgctgcgtactcgattggctcctacatgtacctcatgttggatcgccctgaggggatcatgatggagcgcattgagttcactcagtccaccatcgacatcgctcaagagccctaccggacctacatggaccagaagaagctcatccagattggtgcctatgacatcgacctccaccgcagcttcgtgagcatcgagtcaattctcggtggcctgccatctggcgactccgtgttctacacgattgaccagcaaggcgtgatgcagcggcacgaggggccatggccttcgggttctggattgtcctttccgggcaaccgagctggcgagtatgtggtctttgggcgtgagtacgagttccaatatgagttctccaagttcctcatcaagcagaccgctgacgatggttccacctccactgaggacatcggtcgtctccagcttcggagagcatggttgaactatgagaactctggcgcgtttgagatcaacgtcaacaacggctccactcagtacgtctacccgatgtctggtggtcgcctcgggactcaaacgttcctcggtgagctggctctggggaccgggcagttcaagttccctgtcaccggcaacgcccaggcacaacgagtgacgatcagttctgcaaatcctaacccactcaacatcatcggatgcggatgggaaggtaactacattcgccgttctggcggtatctaatcgactggcatggtggggggtttaatttaccctcactattgccctatgggggatctttatgattttacagaaagcacaacgctggcacctcgaagctgctgcacgagacctcagtcccggtgacctccaagagttccactcccacacggctgggcgcgatccacgagacaccatcccgaactgcctcgatgacacctcaatggtgatcactaagggcgctctggtggtggctgtaggtgggtccaaagattgcctctggtttgtgactaccaacgtggtggacctgctgaccaaggctgaacgtatggagttctatcggatgcttaaagggcatctgagcgtactcaggctgcaaggccatcaatccctgaccaacttcgtgtcagtggacaatcacgcccacatccgtctcctcaacgctctcggtgcgaccttcgcccgtgaacaccacatgagtcctgccggatgtcggttccgtcaattctggctataggaggtcaccatgtgtgaaccagtaagcatcggcatggctgctgttgcggttgtcggtggggctatggctgccaaggacaaggccaagggtgagggtaacgctgaggatgctcaacgtcgcaccgcccgagagcaagtcaagcagaccaacatggctaacgccaacctgcaactgactgcccaagaccgccaagaggaggcccgagcgcaactcgctgaggtcaacatgcaggcgctcaagaacaaaggaacggtggctgctgccatcggtgagtcaatgctttcgggcaactccatcaagcgtattgcgaactcagtggatgtcgaggccagtcaacaaaagatggcgatcaccgacaactacaagcgcgactattcgtcgatctttgcgaaccagattgccaacgtcgagaacaccaagtcggccctcaaaggtcaggctcaagtgatcaagacctcgggtctgagtcatgcccttgggatcgtctctgcgggggccaatggctacgccgctgggtcgtccttgaaaggtcagatgaacgccaacaaggcaactgggcaatccaacggtacagctaaaggaggaacttaatggctaatgaaattgcacgagctttagactcgacccaaatgggtggtaaggaacgccttaagggctccactgcgaccgtccagttccaagcctctcagcaacgtgctgacgtaggcaacaacggcttcgctgactccatggcgagcttcgtgaaggccggggcgaatgcctatggcacctacgctcaagacaaggcgaagaacgctcaggctgagtcggacaagatcatccggtcgatgtccctccagcaacgccgtgaggctatcgcagcgggaaccctgcacctacaggatgaccctgacgtgatgaacgtcctgcgtcacgacactggccggacggctgcctttgaggtggagtccgagatccagaacaagctcgcctctggtgagttcgacaaccaatcccgtgaggaactggatgagtatcgccggacccgtctggagatggtctctcagtcctacgctcaggaagcgggtattgaccctaacgatcctgactaccagcgtggctttaacgccgacatcgtgaagcgtaatgcgggcctattcgacttgcatgaccagcgacgttcccagcgctacattgctcagactgtggtcaacactcgtggcgacactggtggtcttctggatgaccctgagttcatgcgtggtccgggctctggcatcgagatggctgcctacttcaaatcgaaggcatcctctggggcaatcccaactgaccaagcgctcctcgattcagtcaacctcgtgatcaacgatgcggtccagaaggaccacggatcgaccttcctcaagaacttccgagatcagacgatcaccgtgatggggattgagcagaaggtcggtgacgtgatcggtcaggagaaatacgacaacctgatcgccaagtccgctgaggccacctacaagcgcaaccaaccgaagttcgagaagttccaactggatctcgcttcggctgaggctcaggctgacccggctcgtggctgggacatgatcaatcggatcgaggccgagaataagtggattcaggatggtgatggcttcactcagcaaaagcaggcggtcaccagtaccaagctcgccatgctggcaaagatgaaggcccacactcaggcgacccttaaggcaaccgaggaggcgatgcagacggacaaccgcttgcaggccatcgacgaccgctataaggctcgccgtaatggtgccctcttggggaccgctaagcaggacatgcctgtcgatgccaacactggtgagttcaaggagtccgactgggcgacctacgctcaaaagaagctggctcagatcgaggccatggacatccctgtggagcagaaggatcttgagcgcggtcagctcctcaaggacgaccacgagaatggtcctttccgtcgaggcttccaaacgctgatcgacgatgctgccaaggagtggcaaggcgctgttcaattgggcgaactcggggactcccctaagattgaccaactggcacgggtctatgcccagcaaccggaactcattgcgtcactctaccctgagcgcgctggcttcatcgaaaagatgaaccagatgaagcacgttgggattaacccatcggtcctcattgcggctgacgtgaagaactccaagctgaccaaggaggagatgatccaacggaacatccaatgggatgccctcaagagcgaccctaagaacaaagacctctcagcgattccgaacgacatggacaccatggctcgttctctctatgacgccttcaacgctgcaactggcgaccctacggctgcctccaagttgctctccaactggctctcgaagaacaccgttagcttccaagcaggcgatgacgacgaggatgtccagaccggataccaagggatgatcaacaagaaggatctcatggcagacccgaatgacgttaactcgtgggagcagggtaaggccatcgttgaggagaccgttaagggcatcaaggctgctgacccgtactgggctgactcgcctgtgaccatcaccgcttcccgcactggtgacatcaagatctccaccttgactggtgaggtcgtgaccatcaagaagcaatccctccagctcatctacagcgctcgccgtcaggcggaactggaagctcagaaggccgacaaggctgctgagtacgatgaggacgtgaaggatgcacaacgcaatcaaggtctctacaaagactttatccgagggggtcgtggccctctctaatccaatttaggaggaacacatggctaagaaaacctacgctgatgtcaaggccgctggcacgccttacgatggtttgattcgtgaggccgctgatgccaatggcgtgagctatgactacctgcacaaaaagatctttaacgagtccagcttcaaccctcaagctcagtcaccgactgggcctcggggtctgggtcagttcactcgtgccactggtaaggcgtatggtctcgttacagacgaggacttcttcgaccctgccaagtccatcaatgcgtccgctcgccacactgcggatctcctcaagacctacaaaggggactacctcaaggctgcccttgcgtacaaccaagggaatggccgcttgggcgctccccagttgcaagcgctggaccgtggtgacttctccaagatcgcccctgagggtcgtcagtacatggcgaaccttctggacgtggctggtgactctccgtcccgcaagtggttcgagggtccagatgccccaaagctaaccgctgagttccaagaggctacccaagggatctcagcaacaccatccgttgaacaaggtagcctcggtgggaacatcgggatgaacatcgggggctccactgcgcctgcccaagagaagtcgttccgtcaaatggagatcgagcagaacggcccagagaagggcgcatggtacggctcctctgaggccatgttggctgccttgaagacatcgcttcccggccagatctaccggaacatcaccgtcgaggatcatgacccattggagtggatgcaggacacgggcgaccgtgagtggtccaaggaggactacgaccacatccgtaatgaaggtgtcgattcgcaatacttcgacttcattggtgactacacccggtacgacaagcgcaagctgcctgaggctatcgctctcgccaaagagaacatggctcacgacaagaccatcacctccgctggctggggcggtcaactggctgctggtggcgttctcgctgctactgacccactgacctacgtccctgttccgggcaccgctctgcgcacctttggtggccgtgtgttggctcaggggacgttctcctctggtgccgctgtggctggtgagggtatccgtgaggcgaccactgggatcgaaggccactacgctaccgctgctgtaggtggtgctgtgatcggtggaaccatggctgctgtcttggacaagtggattgccaagtcactcgttaagcctgggcgagaagacatgagcgatgaggaactcgaaaggattctcgctcgccacggtgaggctggcctccagtccaacgatgtcaaagtcgatgaggacatgctggcttccactcgcccctctaaggttgacgatgagatggacgatgagtacctcgaaaagatcctcgggatgcacggtgagcgctcccacaaacaagagggtcgaatggaagtctctgacgacaccgttgagggcatccttgcgaggcaccgagagtcaagccaaccgaacgagttcatgggtccaaccatccgcatcaatgcccgtgagcaagctcgtttggctggtgctgatgaccctaccgttatggcatggaagtccgatgagacccctgatgaagccttcgggattcagtacatggaccacccaaaggaaccgggcgctgtgcgtctgcctgatggttcgatcctctcggccagcaatccgctgaaccctaagctcatcaaagcgatggcctctctggagcctgagcgagccgctgctgggttcaagttcggtggcctgactgagatcggtctgatgctgctgcgtagcgaggatgaggagctgagaggtattggcgctcagttgttccgctcgcctactggtggcgtctctgggtctaacggtaagtttggcgctgtggcttctgacgtgatcgagcgtgagcgtggtcaagatcatgtggctctaaacgcaatggtcgatgcccaacaagaagccatgaaggatgtctcggtgaagaccctacccggtggccgtcaggctcagcgtgagtatgtggatcgccggatcgctgaggctatcgaagaccctacagggaccaagctggctcagctcactgaggccgagaagaagtacgccaaggtcgtagaggatcactttgtccgcaaagagaactcccttgagaaccctgcgcagtacggcaacatggacgccacttcgatcatgcctcagacccgtcactctggtcggtacatcccgaacatctacgatgacgccatcaagctgctcaacctccaacgcttcggcggtcctgagggtttgcagaaggcaatcgttgagagctggatggcttcctatctgagccgcgctgctgtgaaaacccgagtggacaagatgatcaaggagtcgctggagaagaatggcaaggtggcaacacctgaggacatcaagaaggctgtcgtagagtacgcctacaacaaggcatacggcattagccacacgactgacttcaaccgctcctcactgatcgacgataacctcgaaggtctggtgggtcaggatgccaacaacttcctcgaaggtcgtcacctgtttgactcggacgtggctgtatcgctgagcgatgggacaaccttctcggttaacgacctgcgcatctttgacgtccctcagatcacctcctcgtacaaccgtcgagtaaatggggacatcgggatcatggctgccactggtaaggacaccactgccctcaaggacgcgatcctcaagatcaaggccaagaatggcaacactcaggaagtggaagccttgcaggagtccatcaagctgctcactgggcgctcacgtcgagaccctgactcagcggctgccacactggctcgtgccttgactgacgtttcgttcttcaccaagaacgcctacatgggcgctcagaacgtcactgagatcgctgggctgatcactaagggccacactcggatgctcatgaagggagtccccttcctccgtgagatgaccacatggggctctaagatcaaacctgagcaactcaaggagatgcacgacatgatcttcggtcgggagctggatgacctcatccgtcctcgccgtgctgacatcgtgcaacgcctgcgcaaccaaggctacagcggggccacggctcagactgtgggcaccatcaagttcgccactggtgagctggctgcccgttcgcctttcaccaagttcctcactgagacctccaactacatcctcgatgctggtcggcaaggtgtccttgtggacctcgtgaaccatgcgctctctgggaagacctcgaagctgttcaacgaggatcgcctgcactcgatgtcgatcaccaaggctcagttcggtgacgtgacgaatgccctcaaggagcatctcgtggctgacccaaaaggtggcttcaagatccgtgatcgggccaagttccaacaagaccctcgggtaatggacatctggcggattggtgacaaggtggccgatgagaccatcctgcgtccccataagttgagcaacaccgatgccattgcgcagaacgcttgggtcaagctggcgatgcagttcaagaacttcgtcctgcgttcggtaaacagtcgcctcctacggggcttctataacgccaccaagaacaagcaggccatcgaccaagcccaacaagtggcgatctcgatgggtctcgcctcgggcttctatgtggcccagcgctacgtccaagctcaagggatgcctaaagaggaacgccgtgacttcctgtcgcggtcactggacatgaacatgatcgcttatgcagcgggctctcgtagctctcacgttggtgcccctctgggtatcgccaacttcgctctggcccctctggggttcgatgcggctgccgctgtgcggacctctgttctgcctcgtggtcctcagtacaccgaacggaaccgggctgtgaaatattccccgcttcgctcctctggcatccaagacccgctctcgaagttcgctgagcaagtacctggcctcggagtcctcgggtcgatctatcagattggcaatggcaccgctggcgtgttccgcgatgaaggtcgggctcaggatcaggactacaagtctgcgatctacaacgggttccgtaacctcgtgccaaacgaccctgccactcagaaggtcaccaacatgcttttccaagagatgggcatggagtacggcaagcgaggccagaaggtccgttaataacccctcactattgggatacatcaactcacgccctgccctaacccggtggggctttttcattaaggagaccacatggcaactaccaccaagacggtgaagacgtatgccctcaacggttccctcaaggacttcacgattccattcgagtatctcgctcgtaagttcgtgagtgttaacttgatcggcgcaacccggcaagagcttgtactcaacgtagacttccgcttttccactccgaccaccatcaccaccttgcgtggttctgcgtggggtccggctgataacttcgacctgatcgagatccgccgttggacttccgccactgagcgtctcgttgacttcgctgatggttcgatccttcgggcctacgacctcaacaccgctcagattcaatcgctccacatcgctgaggaagctcgtgacctaacggctgacacaatcggcgtgaacaacgatggtcaactcgatgcccgtgcgcggcgcattgtgaacctcgctgatgcgatcaaccccggtgacgctgtgaccctgcgccaagagcaacaatggggcggctcagcgctcaaccaagcgaacctctcggctgcctctgcggctgcctctcaggcttcccggctggcatctgaaagtgcccgcgatacgtccatcacctacgctggcgaatcgtacacccatcggattgcctcggagaccgctaagaacgcctcggctgcctctgcgacaaactctgagttgtccaatcagactgcctacaagtgggccaacaaccctgagaacgtggtggtcaacactgggcaatactcagcgttccactgggtccagaaggcaatagcccatgtggctaccgctctgggctacgccaacgctgcctcatcgtctgccactcaggctgcccaaaaggtggctgatgctcaggctcaagtgagtctcgctgctgctcaggcgaccatcgcaaccaacaaggctgctgaggctgctacaagcgcttcccagttgggcggtgcgattggtattggtgacaacatctcgtccactgcgagcggtgacgggaactggaaggtggtcttcaagggcatcgtacagactgtcggtgcgttcttcggtaagcgttttgaggcccagccttacaccgaggcgactggctttgccaaccaatgggcctcctctgcacccttcttgactcaggaaggcgtactcgacaacacctcagcgtactacccaatcatcaaaggtaagtatggtcaggctggagtaggtcatgcaccgtccatgggagtccttacgcgaactgatggtaaccacgccttgacactccactggggcaactcagcggggactggcccaatactgcttcaactgaacaaagatggcctgaacgcctccttctcagggagcatctcatcggggcctgctggtgcaatctactctggcactggtggggtatacgactcaggtagtcgcgtttggtcagccgcttccttcaacccagcctacaagctgtctggtactggtggcaccacaacgatgggtaacaacaacgctgtatgtggcgttacctacacgaacctctcggctcccaaccaagtttacaacggcgcctttgagatccgtgagaacggcctcgtaggtaatggtggaccagctcccggccatatctacaacgcaccagccattgccttccactggggggcgactgttgtttctaagctgatgatgaacgccgctggggcattgtgctggggtaacccttcatcgcagttcatgcagatctccccggatgggaacatcttcggttccgttttcggtaaccagtgggcgaccacctacatctacaacaccgccaacgagcgtgccagcgcgtgggcagttcaagagtctcgcaacccaaacaacattggcatcgctatgtcggccttccgcgtcaactcgctgggctgccacatgctggctctggctcacaacaactcgggcgtggagtggaacgaaggtgtccccggcggcaacctcactgccaccaacaccggtggtacttacttcgctggttacaacttggctggtaactacgttcggatgggtaagttggttaacgctgacggcgcatcccctgactccgtgaccctatacatgcgctatgcgtaaggaggattaatggctaacagatctatcgtggacgtgaagaatgtccaatggtgctgccctaacaaggatgcagcctactgcctcgtaaagttctcggacatcgaggactacatcgagtacaccgctgtgcgtggtgatgaagttgcgcatggtaatgaactattccagatcatcgaccgtggtctcgctggggacatccctgagtataccggtccagaccaatcgcagatcgaggcttggaacctgctcatggaggaggtctctgcgcttcgtgtggagttcgacaagatcatccccgaggtccaattgggcctcgcatcgcctgacaaagtggaacgcgccaagtacctctatggccgcatcaaggacatcgagtcgtaccacaaagcgacctatgacctgacgttctgctacgtcaaccgtgaggtgtcctaatgggcatctccatcgacttcaacaacggggtagtccaagcgaccccagtcgtgggagctgctgtaactgacgtgacggcccggttgtttctgggcctttcaccaagtgagtggttctacgcatccgccgttttgtactccctcgtgatgactgtaatcgtggtttacaagaccgttaaagaagaacgccgcaaagacaaggaggctgagaaatgagtgatgacttactgatgcgcctgctggtcgcgctggacactgacatggcaaagaacatgttggctgaccttcgtgatcctgagcgtagaacgcctcagctctacaacgctgtgggcaagctgctggaacgccacaagttcaccatcgccaagctgcaaccggatgagtcccttctgggcgatctcgcttcggctctcgatgagatccctgagttaactgacgacgagctgtacgcctcggacgttcgccactaaaggaggccctgcatgttgaaccttaaagagttcgtcatgtggggccttttggtttgcacaggcttaggtctgacgtatgccaaaggtcactctgacgcaaccgacactctgaccctcaaacatcaaactgaacaactggcggctgcccgtcaactggaggtggaacgtgaaacaacccaaagagccctcgctgatgtctcgaagaactggcaagcctatctctcaacgagtaaggcatctgctgatcggactattgctggtctgcgtagcaatggtatcagcctgtcagtcgccctcgcagatgccaccgtcaagtgcgtcacggctgacggtagacccctcgctgatggtcgcgccgagctacgagaaagcgatggtcgatttcttatcgaacaagcccaacgagcagacgcccaagtgaagggcctgcaagattccattaagaccattcaaggaggaactaaatgagcgcaccccgtaatgggggcgacgacatagcgttaatgaaaaggtcattcgtggcctttctttttgtcctgtggagagccctcaacctacccaaaccaaccaagtgtcagatcgacatgtccaagaagctcagctctggtgacgaacgtcgattcatccttcaagcattccgaggtatcggcaagtccttcatcacctgcgcattcgttgtgtggaagctgtggggcaacccggacctcaagttcatgatcgtgtccgcttccaaggaacgggcagacgccaactccatcttcatcaagcggatcatcgagctgcttccattcctccacgagctgaaaccacggacgggtcaacgagactccgctctggccttcgacgtgggtctcgccaagcctgaccactcgccctcggtgaagtcggtaggtatcacaggccagctcacaggttcccgtgcggacatcctcattgcggatgacgttgaggttccgaacaactctggcacccagtctgcgcgtgacgccctgggagaacttgtgaaggagttcgatgcgatcctgaaaccgggcggtacgatcatctatctgggcacacctcagaccgagatgaccctctatcgtgagctggaaggccgtggctacgtcactaccatctggcctgcgagataccctaaagatcagaaggattgggactcctatggcccacggctggccccgatgctggaggctgagctgagagctgatggttccctgttctgggcaccgactgaccctgtacgcttcgacgatacagatctcagggaacgtgaactctcctacgggaaaggtggcttcgccctccagttcatgctcaaccctaacctcagtgacgccgagaagtaccctctcaagctgcgtgatttcatcgtagggacgttcgacatgatgaaagggccaaccaccctgacatggatgccaaacgccaacaacgaggtcaagggcgttcctctggtgggtctcaaaggtgaccgcttccaccgttacgaagctgtaggtcaggccactgcgcagtacgctcagaaaatccttgtgatcgacccatcggggcgcggtaaggatgagactggctatgcagtcctgtaccagttgaacggctacatcttccttatggacgctggtggcttccgtggtggctacgaggacacaaccctccaagccctctcgaacctcgccaagatctacaaggtcaatgaggtcgtgatcgagggtaacttcggtgacggtatgtacctcaagctgatcagtcctgtgctgaccgctacatggccgtgcgcgatcactgaggtcaagtccaagggtcagaaggaactccgcatctgcgacgttctggagcccgtactgggcagccataagctggttctcagcgaggccctcatcgacaaggactaccggactgcgctcaacgctgacgggaccactgacatcaagtacagcctgctctatcagctctctcggatcacccgtgagcgtgggtcgctggcccatgatgaccgcttggatgcccttgcgattggcgtccagttcttcactgaggccatggagaaggattccaagctgggcgagtcggaactgatggctgagttcttggaggcccagatggagaaccaactgatgggctttgaggacgtcagaaggatcgcaatcagtgactccgtggacatcatgttcgacgatgaaggctcaatgaccaactatatgggctggtaggatgtctgcatgatcgaagcatgatcgacgaagtttatttaccctcactattgggagaggcccaccctaagatacctaagagattcctaacaagatctcagcaaggttcttaaggtggtgcctctaacctttgggttcctcaggatgaggtccgaccaaaggaactggaccaaggatggttatcaactatgatcattatcaagaaggaggtcaaaccatggacgtagagaaagccaccgtgctgctcgtactcaagcggttggctctctccaagaccacctacaagctcatcggcaccttgctggtggccttaggtgtcctcaatggcaatgatgtcatgaacatggtctctggcctcgtatgtgtggcatctggtggctgcgtagagtgaccgacacgaccaatttcggtatggttacaccctacctcattggtcagcttaagaaagcccttaggtgtcctcataggcccttagggtcttccttaggataaccgatagatggcacttgcatgaacccattggataccttaggatgtcctttaagaatctgatagaaaaatctgaaagggcacctctcatagacaaacgcccacgaatcccccccatagggcctctctcagccatcctcggggctctgctccccatagggcatctcaatgatcatctgagggatacgttaggtacatcgttaggctgtcacatggtgggctcctttgagatcccgttgaggtagcgttaggatggaccttagggagcgtgatgtcaaccctgtggattcatacagtagtccgtctgtccctatctgtatcagcaatccttagggccatccttagggccatccttaggctactcccagggtgatcatgtgacgcctctccttagggccatccttagggctcctataaggtgcctgtagaccctgctccttaggatggccttgagttgcctatatagaggcgatgcgtagcctatgagttgttacaggctgacctatacactggatgaataaacaggttgacggcgatgctcagttctatacaatgggccacatcaacaacgagacacggcctaacgggtgtctctgagttggtcgcttagcttagtagcatctgacctgcgatcatacgtgtgccaagggtcttaagggtgacgaacgataagcgacacaagggcagaaacaaacgcttgacaacaccgcaacacgctgtagaatacgccacatcaacaacgaaacacgcaacgagc

SEQ ID NO: 4 - DNA, 41335 bp, unidentified
  misc_feature 1..11: note = bacteriophages nucleic acid sequence
  source 1..41335: mol_type = genomic DNA
cttgctcgggttgatcccgccgttgtcctcagcgtatgcggccatctccttgagggtctcaagatgctcacgcagaaggggatggtacttgtcaaccgatgcgatacccgtggtggccttagtgagaacggtactcatccgaacactcccagtgcgacgagtccatgcccagcaccaccaccaaccgcaagcgcagtcaagtacccaagggtctctttaagtgctgatttccaacgattttttgcaggtttgggcttgctttcagcttccagttctgcatcacgacgacgagcggtcaacaaaggatgttcggaacgtgtgtataattcgctcaacaaccccgagaaggctcgctcatgctcctcggaccagacgaagcaggcttgcaagatcaggctgccaacgtcttgaccagaaccagcaaggaactggaaggtgtagcccccgaagtcgtcgggttttacgtccacacggagccagcgttgcccgtgccggttctccacatagtgggcgtaaccatcagagagagcgccacgcatagcagcgatgagacgttcagcaaatgcagccgaggtgaagttagtacggttgtagcgttgcataattcaaagacctaagacgtgcggtaaatggagcggtacagaatgcccacctttgcgctgttatcgacgcgaaggcaggctcttattgaccatcgtagagaggtgcttatttgcccggtggcaacatgccttcgattggcttgcccgattgttgctgaatcagcaggtccagcttgaggcgttccagtgcagcggcctcatcgcgttgcttctgctcgtcttcaaggcgttgcttttcggccttctcctcgttgctggagttgttccaccagttcgccagagaggtgcccgcaaaggagcccgctacggtactcatgaagccaccagagccaccgcccatggccgctggagccgattgatggaccacagtggtacggttgacggtgacgttctggacgacccgaggggcaggcttgtaggagctggtacgcggtgcgctgtaagagcgggatgagctggagctactcgaccgactacccgagaaacctcgtgcctcagcgtcattcgcatggatggccccgagggcgatcacggtagcgaacagagcgaacaggcagatgtttttggactggcgagcgattgcgtggatcatttggatctcctatgtggtttgcgttgagttgttcccaatgagccctcagcgaaggcccatcagtgaatcactcggcgtctatggtggcttcgtcgaaccatctggagaacatggactcgaacgatgtgatggcgctgtagtctgctatgacctcctcagcggagttcccatagaccagccagaacttgccgatgcgttggtaggtgccgtcatcagggcgaacccggtagaccaccacatggtcctcatcggtagccatgcaggcgtcaatgcccacttgcacggtgtaggtgtggttggtctcgaagtcctcgccgttgttgatgcggaagcagtagccagagccagtgatcgcagtgagcagcttacggaggactcgacgttccccaatgatgcgctcagcggtggccggatacttggccttgatttgctcgttggtcattttcattgcacttgctccagacgggagaggaagacgtagaactgacgacccggtgacagcgaggctgtagcggatggcttgtagcgcatcgcttgagcccactcatagagcgtgttggattgactggaggagagcgtgtgaggatcttgcccgaacttgatgccctccttcttgagttcctcaatgatcacccggtagagcatctggcggaaggtaggaacgctcatttcaggtactccccggactcaatgagcatccgagcggcttccttggtgatgcaggtgttctcactcggtgaccaatacatggtgcccttaggaacatcgctgtaggcacactcggtgacggtgcgaccaaccatctgcttgatgtcgcattggtcccactggtgcagccttgaggactcattgaggtagtggtcaccaccattgaggtaggcattgcccatgagtgcccattgcgacttgctaaagtgggccttgacgacacggagaacagcaggtgtgacgaactgagcgtagtagcgacgatgagccgcgctgccatcctgctcagggtattccgtggaggtcttgcggccatccatgtaccaatagcgggtcaggtagaccttatcgttgatcattacgatgtcagcggtgtgttgcttagccatggtgattgctcccaggttgttggtgtgacgttgagttgttcccatagagccctcaaggaaggccctacagtgaatcgctcaataacccgcccagcggcgcaactcgccgtagttcaggaagggccacggatgaaccttgccgttctcatagacccagatggcgaggtgaccggcctcagtgcgataccacgatttaaaccagtcgtgttgcttggcccatgcaatgacagcctcgtcgatgtctgggcgtggcgtgttgtgactcatggtcactccttgtcagcgttgagttgttcgagcaggtcagccttagtgcgatgccacacggcctcaaggacacggcagcgagtcagcgttgagtcaacctcattgcgcagcttctcccacataggatgagcagcagagccctcaaagcgcccaaagatggccttagcggcttgatgctcagcctcagccttcacaatacgtgcatcgaggtcagccagctcagtgcgtatacgatcagtgcgtgtactcatggtgatgctccttgcttgtgtgttaagagatacagacgaaggctctccacgtcccgtgctaatgcttagatacacgagagccctcttgctgtatttcctttcactgctacgcaccgagggtctgagcaagcccgttaagacgtcagcccgtctcagtgcgtagtgttgcagtccaagtttttaaagagcgtaagggtgcccgttaggccgtagttatcggccaattcgttgcccttcttgcgacccatgctggtgactttgacctcacccgacccaccctactcatgacatctgctcaggtagctcgttgcgtgtttcgttgttgatgttgcgtattctacagcgtgttgcgatgttgtcaagcgtttgtttctgcccttgtgtcgctcatcgttcgtcacccttaagacccttggcacacgtatgatcgcaggtcagatgctactaagctaagcgaccaactcagagacacccgttaggccgtgtctcgttgttgatgtggcccattgtatagacttgaatgatgccgtcaacctgtttattcatccagtgtataggtcagcctgtaacaacctatagaggctttgaggctggtctactggtcttcatataggagcctttgagatgtcctaaggaggaggcaccagagaggccctaaggagctacctatagagcagccctaaggatggccctaaggattgctgatacagatagggacagatggactactgtatgaatccacagggttgacatcacgctccctaaggtccatcctaaggccacctcaacgggatctcaaaggagcccaccatgcgatagcctaacgatgtacctaacgtatccctcagatgatcattgagatgccctatggggagcagagcacttgggatggctgagagaggccctatggggggattcgtgggcgtttgtctatgagaggtgccctttcagatttttctatcagattcttaaaggacatcctaaggtatccaataggttcatgcaagtgccatctatcggttatcctaaggaagaccctaagggcctatgaggactcctaagggctttcttaagctgaccaatgaggtagggtgtaaccataccgaaattggtcgtgtcggtcactctacgcagccaccagatgccacacacacgaggccagagaccatgttcatgacatcactgccattgaggacacctaaggccaccagcaaggtgccgatgagcttgtaggtggtcttggagagagccaaccgcttgagtacgagcagcacggtggctttctctacgtccatggttgtggtctccttcttggtaatgatcatagttgataaccatccttggtccagttcctttggtcggacctcatcctgaggaacccaaaggttagaggcaccaccttaagaaccttgctgagatcttgttagggatctcttaggtatcttagggtgggcctctcccaatagtgagggtaaataaacttcgtcgatcatgcttcgatcatgcagacatcctaccagcccatatagttggtcattgagccttcatcgtcgaacatgatgtccacggagtcactgattgcgatccttctgacgtcctcaaagcccatcagttggttctccatctgggcctccaagaactcagccatcagttccgactcgcccagcttggaatccttctccatggcctcagtgaagaactggacgccaatcgcaagggcatccaagcggtcatcatgggccagcgatccacgctcacgggtgatccgagagagctgatagagcaggctgtacttgatgtccgtggtcccgtcagcgttgagcgcagtccggtagtccttgtcgatgagggcctcgctgagaaccagcttatggctgcccagtacgggctccagaacgtcgcagatgcgtagttccttctgacccttggacttgacctcagtgatcgcgcacggccatgtagcggtcagcacaggactgatcagcttgaggtacataccgtcaccgaagttaccctcgatcacgacctcattgaccttgtagatcttggcgaggttcgagagggcttggagggttgtgtcctcgtagccaccacggaagccaccagcgtccatcaggaagatgtagccgttcaactggtacaggactgcatagccagtctcatccttaccgcgccccgatgggtcgatcacaaggattttctgagcgtactgcgcagtggcctgacctacagcttcgtagcggtggaagcggtcacctttgagacccaccagaggaacgcccttgacctcgttgttggcgtttggcatccatgtcagggtggttggccctttcatcatgtcgaacgtccctacgatgaaatcacgcagcttgagcgggtacttctcggcgtcactgaggttagggttgagcatgaactggagggcgaagccacctttcccgtaggagagttcacgttccctgagatctgtatcgtcgaagcgtacagggtcagtcggtgcccagaacagggaaccatcagctcgcagctcagcctccagcataggagccagccgtggtccataggagtcccaatccttctgatccttagggtatctcgcaggccagatggtagtgacgtagccacggccttccagctcacgatagagggtcatctcggtctgaggggtgcccagatagatgatcgtaccgcccggtttcaggatcgcatcgaactccttcacaagttctcccagggcgtcacgcgcagactgggtgcccgagttgttcggaacctcaacgtcatccgcaatgaggatgtccgcacgggaacctgtgagctggcctgtgatacctaccgacttcaccgatggcgagtggtcaggcttggcgagacccacgtcgaaggccagagcggagtctcgttgacccgtccgtggtttcagctcgtggaggaatggaagcagctcgatgatccgcttgatgaagatggagttggcgtctgcccgttccttggaagcggacacgatcatgaacttgaggtccgggttgccccacagcttccacacaacgaatgcgcaggtgatgaaggacttgccgatacctcggaatgcttgaaggataaatcgacgttcgtcaccagagctgagcttcttggacatgtcgatctgacacttggttggtttgggtaggttgagggctctccacaggacaaaaagaaaggccacgaatgaccttttcattaacgctatgtcgtcgcccccattacggggtgcgctcattcagttcctccttggatggtcttaatggaatcttgcaggcccttcacttgggcgtctgctcgttgggcttgttcgataagaaatcgaccatcgctttctcgtagctcggcgcgaccatcagcgaggggtctaccgtcagccgtgacgcacttgacagtggcatctgcgagggcgactgacaggctgataccattgctacgcagaccagcaatagtccgatcagcagatgccttactcgttgagagataggcttgccagttcttcgagacatcagcgagggctctttgggttgtttcacgttccacctccagttgacgggcagccgccagttgttcagtttgatgtttgagggtcagtgtgtcggttgcgtcagagtgacctttggcatacgtcagacctaagcctgtgcaaaccaaaaggccccacatgacgaactctttaaggttcaacatgcagggcctcctttagtggcgaacgtccgaggcgtacagctcgtcgtcagttaactcagggatctcatcgagagccgaagcgagatcgcccagaagggactcatccggttgcagcttggcgatggtgaacttgtggcgttccagcagcttgcccacagcgttgtagagctgaggcgttctacgctcaggatcacggaggtcagccaacatgttcttcgccatgtcagtgtccagcgcgaccagcaggcgcatcagtaagtcatcactcatttctcagcctccttgtctttgcggcgttcttctttaacggtcttgtaaaccacgattacagtcatcacgagggagtacaaaacggcggatgcgtagaaccactcacttggtgaaaggcccagaaacaaccgggccgtcacgtcagttacagcagcacctacgactggagtggcttgcaccaccccgttgttgaagtcgatagagatgcccattaggacacctcacgattgacgtagcagaacgtcaggtcataggtcgctttgtggtacgactcgatgtccttgatgcgtccatagaggtacttggcgcgctctacacgatcaggtgcagcgaggcccaattggacctcagggatgatcttgtcgaactccacacgaagcgcagagacctcctccatgagcaggttccatgcctcgatctgcgattggtcgggaccggaatactcagggatgtccccagcgagaccccggtcgatgatctggaatagttcattaccatgcgcaacttcgtcgccacgcacagcggtgtactccagccattcgtcaatatccgagaacttgacgaggcagtaggctgcatccttgttagggcagcaccattggacgttcttcacgtccacgatagatctgttagccattgggcctccttacgcatagcgcatgtaaagggttactgagtcaggcgatgcaccgtcagcgttgacgagcttgcccatacggacgtagctaccagccaagttgtagccagcgaagtaagtgccgccagtgttggtgccagtgaggttgccgccagcgacaccttcgttccactccacgcccgagttgttgtgagccagagccagcatgtgacagcccagagagttgactcgcagaccggacatggcgatgccgatgttgttgacgttgcgggactcttgaactgcccaagcgttggcccgctcgttggcggtgctgtagatgtaaccggtcacccattggttgccaaaaacggaaccgtagatgtttccatccggggcgatctgcatgtactgcgatgaagggttaccccagcacaaggagccagcagcgttcatcatcagcttagaaacaaaggtcgcgccccagtggaaggagatgcccggtgcgttgtagatgtggccgggagctggtccaccgttacctacgaggccgctctcacggatctcaaaggcaccgttgtaaacttggttagcagccgagaggttcgtgtaggtgacgccacagacttggttgttgttgcccatcgtagtggtcccaccagtaccgcccagtttgtaggctgggttgaagttaccagttgaccacacgcggttacctgagtcgtaaaccccaccagtacccgagtagattgcaccagtagaccccgatgagatgctccctgagaaggaggcgttcaggccgtctttgttcagttgaagcagcactgggccagtccccgctgagttgccccagtggagtgtcaaggcgtggttaccatcggttctcgtcaggacgcccatggacggcgcatggcctgctccagcctgaccatacttacctttgatgattgggtagtaagctgaggtgttgtcgagtacaccttcctgagtcaagaagggcgcagaggtggaccattggctggaaaaaccagccgactcggtgtaaggctgggcctcaaagcgcttaccgaagaacgcacctacagcctgtacgatgcccttaaagaccaccttccagttcccatcaccgctcgcagtggacgagatgttgtcaccaataccaatcgcaccgcccaactgggaagcgcttgtagcagcctcagcggccttgttggttgcgatggtcgcctgagcagcagcgagactcacttgagcctgagcgtcggtcaccttttgggcagcctgagtggcagacgatgaggcagcgttggcgtagcccagagcggtagccacatgggcgattgccttctggacccagtggaacgctgagtattgcccagtgttgaccaccacgttctcagggttgttggcccacttgtaggcagtctgattggacaactcagagtttgtcgcagaggcagccgaggcgttcttagcggtctccgatgcgacccgatgggtgtacgattcgccagcgtaagtgatggacgtatcgcgggcactttcagatgccagccgggaagcctgagaggcagccgcagaggcagccgagaggttcgcttggttgagcgctgagccgccccattgttgctcttggcgcagggtcacagcgtcaccggggttgatcgcatcagcgaggttcacaatgcgccgcgcacgggcatcgagttgaccatcgttgttcacgccgattgtgtcagccgtgaggtcacgagcttcctcagcgatgtggagcgattgaacctgagcggtgttgaggtcgtaggcacgaaggatcgaaccgtcagcgaagtcaacgagacgctcagtggcggaagtccaacggcggatctcgatcaggtcgaagttgtcagccggaccccagccagaaccacgcaaggtggtgatggtggtcggagtggagaagcggaagtctacgttgagtacaagctctttccgggttgcgccgatcaagttgacactcacgaatttacgagcgagatactcgaatggaatcgtgaagtccttgagggaaccgttgagggcatacgtcttcaccgtcttggtggtagttgccatgtggtctccttaatgaaaaagccccaccgggttagggcagggcgtgagttgatgtatcccaatagtgaggggttattaacggaccttctggcctcgcttgccatactccatgcccatctcttggaaaagcatgttggtgaccttctgagtagcagggtcgttcggcacgaggttacggaacccgttgtagatcgcagacttgtagtcctgatcctgagcccgaccctcatcgcggaacacgccagcggtgccattgccaatctgatagatcgacccgaggactccgaggccaggtacttgctcagcgaacttcgagagcgggtcttggatgcccgaggagcggagcggggaatatttcacagcccggttccgttcggtgtactgaggaccacgaggcagaacagaggtccgcacagcagcagcagcatcgaaccccagaggggccagagcgaagttggcgatacccaaaggggcaccaacgtgagagctacgagagcccgctgcataagcgatcatgttcatgtccagtgaccgcgacaggaagtcacggcgttcctctttaggcatcccttgagcttggacgtagcgctgggccacatagaagcccgaggcgagacccatcgagatcgccacttgttgggcttggtcgatggcctgcttgttcttggtggcgttatagaagccccgtaggaggcgactgtttaccgaacgcaggacgaagttcttgaactgcatcgccagcttgacccaagcgttctgcgcaatggcatcagtgttgctcagcttgtgtggacgcaggatggtctcatcggccaccttgtcaccaatccgccagatgtccattacccgagggtcttgttggaacttggcccgatcacggatcttgaagccaccttttggatcagccacgagatgctccttgagggcattcgttacgtcaccgaactgagccttggtgatcgacatcgagtgtaggcgatcctcattgaacagcttcgaggtcttcccagagagcgcatggttcacgaggtccacaaggacaccttgccgaccagcatcgaggatgtagttggaggtctcagtgaggaacttggtgaaaggcgaacgggcagccagctcaccagtggcgaacttgatggtgcccacagtctgagccgtggccccgctgtagccttggttacgcaggcgttgcacgatgtcagcacggcgaggacggatgaggtcatccagctcccgaccgaagatcatgtcgtgcatctccttgagttgctcaggtttgatcttggagccccatgtggtcatctcacggaggaaggggactcccttcatgagcatccgagtgtggcccttagtgatcagcccagcgatctcagtgacgttctgagcgcccatgtaggcgttcttggtgaagaacgaaacgtcagtcaaggcacgagccagtgttgcagccgctgagtcagggtctcgacgtgagcgcccagtgagcagcttgatggactcctgcaaggcttccacttcctgagtgttgccattcttggccttgatcttgaggatcgcgtccttgagggcagtggtgtccttaccagttgcagccatgatcccgatgtccccatttactcgacggttgtacgaggaggtgatctgaggaacgtcaaagatgcgcaggtcgttaaccgagaaggttgtcccatcgctcagcgatacagccacgtccgagtcaaacaggtgacgaccttcgaggaagttgttggcatcctgacccaccagaccttcgaggttatcgtcgatcagcgaggagcggttgaagtcagtcgtgtggctgataccgtatgccttgttgtaggcgtactcgacgacagccttcttaatgtcctcaggtgttgccaccttgccgttcttttccagcgactccttgatcatcttgtccactctggttttcacagcagcacggctcagataggaagccatccagctctcaacgattgccttctgcaaaccctcaggaccgccgaagcgttgtaggttgagcagcttgatggcgtcatcgtagatgttcgggatgtaccgccccgagtgacgggtctgaggcatgatcgaagtggcgtccatgttgccgtactgcgcagggttctcaagggagttctctttgcggacaaagtgatcctcgacaaccttggcgtacttcttctcggcctcagtgagctgagccagcttggcccctgtagggtcttcgatagcctcagcgatacggcgatccacatactcacgctgagcctgacggccaccgggcagggtcttcaccgagacgtccttcatggcttcttgttgggcatcgaccatggcgtttagagccacatgatcttgaccacgctcacgctcgatcacgtcagaagccacagcgccaaacttaccgttggacccagagacgccaccagtaggcgaacggaacaactgagcgccaatgcctctcagctcctcgtcctcgctacgcagcagcatcaggccgatctcagtcaggccaccgaacttgaacccagcagcggctcgctcaggctccagagaggccatcgctttgatgagcttagggttcagcgggttgctggccgagaggatcgaaccatcaggcagacgcacagcgcccggttcctttgggtgatccatgtactgaatcccgaaggcttcgtcaggggtctcatcggacttccatgccataacggtagggtcgtcagcaccagccaaacgagcttgctcacgggcattgatgcggatggttggacccatgaactcgttcggttggctcgactctcggtgcctcgcaaggatgccctcaacggtgtcgtcagagacttccattcgaccctcttgtttgtgggagcgctcaccgtgcatcccgaggatcttttcgaggtactcatcgtccatctcatcgtcaaccttagaggggcgagcggaagccagcatgtcctcatcgactttgacatcgttggactggaggccagcctcaccgtggcgagcaagaaccttttcgagttcctcatcgctcatgtcttctcgcccaggcttaacgagtgacttggcaatccacttgtccaagacagcagccatggtgccaccgatcacagcaccacctacagcagcggtagcgtagtgaccttcgatcccagtggtcgcctcacggatgccctcaccagccacagcggcaccagaggagaacgtaccctgagccaacacacgcccaccaaaggtgcgcagagcggtgcccggaacagggacgtaggtcagtgggtccgtagcagcgagaacgccaccagcagccagttgaccaccccagccagcggaggtgatggtcttgtcgtgagccatgttctctttggcgagagcgatagcctcaggcagcttgcgcttgtcgtaccgggtgtagtcaccaatgaagtcgaagtattgcgaatcgacaccttcattacggatgtggtcgtagtcctccttggaccactcacggtcgcccgtgtcctgcatccactccagtgggtcatgatcctcgacggtgatgttccggtagatctggccgggaagcgaggtcttcaaggcagccaacatggcctcagaggagccgtaccatgcgcccttctctgggccgttctgctcgatctccatttgacggaacgacttctcttgggcaggcgcagtggagcccccgatgttcatcccgatgtttccaccgaggctaccttgttcaacggatggtgttgctgagatcccttgggtagcctcttggaactcagcggttagctttggggcatctggaccctcgaaccacttgcgggacggagagtcaccagccacgtccagaaggtttgccatgtactgacgaccctcaggggcgatcttagagaagtcaccacgatccagcgcttgcaactggggagcgcctaagcggccattcccttggttgtacgcaagggcagccttgaggtagtcccctttgtaggtcttgaggaggtccgcagtgtggcgagcggacgcattgatggacttggcagggtcgaagaagtcctcgtctgtaacgagaccatacgccttaccagtggcacgagtgaactgacccagaccccgaggcccagtcggtgactgagcttgagggttgaagctggactcgttaaagatctttttgtgcaggtagtcatagctcacgccattggcatcagcagcctcacgaatcaaaccatcgtaaggcgtgccagcggccttgacatcagcgtaggttttcttagccatgtgttcctcctaaattggattagagagggccacgaccccctcggataaagtctttgtagagaccttgattgcgttgtgcgtccttcacgtcctcatcatactcagcagccttgttggccttctgagcttccagttccgcctgacggcgagcgctgtagatgagctggagggattgcttcttgatggtcacgacctcaccagtcaaggtggagatcttgatgtcaccagtgcgggaagcggtgatggtcacaggagagtcagcccagtacgggtcagcagccttgatacccttgacggtctcctcaacgatggccttaccctgctcccacgagttaacgtcattcgggtcggccatgagatccttcttgttgatcatcccttggtagcctgtctggacatcctcgtcgtcatcgccagcttggaagctaacggtgttcttcgagagccagttggagagtaacttggaggcagccgtagggtcgccagttgcagcgttgaaggcgtcatagagggaacgagccatggtgtccatgtcgttcgggatcgcagagaggtctttgttcttagggtcgctcttgagggcatcccattggatgttccgttggatcatctcctccttggtcagcttggagttcttcacgtcagccgcaatgaggaccgatgggttaatcccaacgtgcttcatctggttcatcttttcgatgaagccagcgcgctcagggtagagtgacgcaatgagttccggttgctgggcatagacccgtgccagttggtcgatctttggggagtccccgagttcgcccaattgaacagcgccttgccattccttggctgcatcgtcgatcagcgtttggaagcctcgacggaaaggaccattctcgtggtcgtccttgaggagctgaccgcgctcaagatccttctgctccacagggatgtccatggcctcgatctgagccagcttcttttgagcgtaggtcgcccagtcggactccttgaactctccagtgttggcatcgacaggcatgtcctgcttagcggtccccaagagggcaccattacggcgagccttgtagcggtcgtcgatggcctgcaagcggttgtccgtctgcatcgcctcctcggttgccttaagggttgcctgagtgtgggccttcatctttgccagcatggcgagcttggtactggtgaccgcctgcttttgctgagtgaagccatcaccatcctgaatccacttattctcagcctcgatccgattgatcatgtcccagccacgagccgggtcagcctgagcctcagccgaagcgagatccagttggaacttctcgaacttcggttggttgcgcttgtaggtggcctcagaggacttggcgatcaggttgtcgtatttctcctgaccgatcacgtcaccgaccttctgctcaatccccatcacggtgatcgtctgatctcggaagttcttgaggaaggtcgatccgtggtccttctggacagcatcgttgatcacgaggttgactgaatcgaggagagcttggtccgttgggattgccccagaggatgccttcgatttgaagtaggcagccatctcgatgccagagcccggaccacgcatgaactcagggtcatccagaagaccaccagtgtcgccacgagtgttgaccacagtctgagcaatgtagcgctgggaacgtcgctggtcatgcaagtcgaataggcccgcattacgcttcacgatgtcggcgttaaagccacgctggtagtcaggatcgttagggtcaatacccgcttcctgagcgtaggactgagagaccatctccagacgggtccggcgatactcatccagctcctcacgggattggttgtcgaactcaccagaggcgagcttgttttggatctcggactccacctcaaaggcagccgtccggccagtgtcgtgacgcaggacgttcatcacgtcagggtcatcctgtaggtgcagggttcccgctgcgatagcctcacggcgttgctggagggacatcgaccggatgatcttgtccgactcagcctgagcgttcttcgccttgtcttgagcgtaggtgccataggcattcgccccggccttcacgaagctcgccatggagtcagcgaagccgttgttgcctacgtcagcacgttgctgagaggcttggaactggacggtcgcagtggagcccttaaggcgttccttaccgcccatttgggtcgagtctaaagctcgtgcaatttcattagccattaagttcctcctttagctgtaccgttggattgcccagttgccttgttggcgttcatctgacctttcaaggacgacccagcggcgtagccattggcccccgcagagacgatcccaagggcatgactcagacccgaggtcttgatcacttgagcctgacctttgagggccgacttggtgttctcgacgttggcaatctggttcgcaaagatcgacgaatagtcgcgcttgtagttgtcggtgatcgccatcttttgttgactggcctcgacatccactgagttcgcaatacgcttgatggagttgcccgaaagcattgactcaccgatggcagcagccaccgttcctttgttcttgagcgcctgcatgttgacctcagcgagttgcgctcgggcctcctcttggcggtcttgggcagtcagttgcaggttggcgttagccatgttggtctgcttgacttgctctcgggcggtgcgacgttgagcatcctcagcgttaccctcacccttggccttgtccttggcagccatagccccaccgacgaccgcaacagcagccatgccgatgcttactggttcacacatggtgacctcctatagccagaattgacggaaccgacatccggcaggactcatgtggtgttcacgggcgaaggtcgcaccgagagcgttgaggagacggatgtgggcgtgattgtccactgacacgaagttggtcagggattgatggccttgcagcctgagtacgctcagatgccctttaagcatccgatagaactccatacgttcagccttggtcagcaggtccaccacgttggtagtcacaaaccagaggcaatctttggacccacctacagccaccaccagagcgcccttagtgatcaccattgaggtgtcatcgaggcagttcgggatggtgtctcgtggatcgcgcccagccgtgtgggagtggaactcttggaggtcaccggggctgaggtctcgtgcagcagcttcgaggtgccagcgttgtgctttctgtaaaatcataaagatcccccatagggcaatagtgagggtaaataaacccccaccatgccagtcgattagataccgccagaacggcgaatgtagttaccttcccatccgcatccgatgatgttgagtgggttagggtttgcagaactgatcgtcactcgttgtgcctgggcgttgccggtgacagggaacttgaactgcccggtgcccagagccagctcaccgaggaacgtttgagtcccaaggcgaccaccagacatcgggtagacgtactgagtggagccgttgttgacgttgacctcaaacgcgccagagttctcatagttcaaccatgctctccgaagctggagccgaccgatgtcctcagtggaggtggagccatcgtcagcggtctgcttgatgaggaacttggagaactcatattggaactcgtactcacgaccgaagaccacatactcaccagcccggttgcccggaaaggacaagccagaacccgaaggccatggaccttcatgtcgctgcatcacgccttgctggtcaatcgtgtagaacacggagtcgcccgatggcaggccaccgagaatggattcgatgctcacgaagctacggtggaggtcgatgtcataggcaccgatctggatgagcttcttctggtccatgtaggtccggtagggctcctgagcgatgtcgatggtggactgagtgaactcaatgcgctccatcatgatcccctcagggcgatccaacatgaggtacatgtaggagccaatcgagtacgcagcgaggatcttaacgttggtcccgaagttccagtgggagaacgattgttgctggaggatctcgtcgaggtacaggaacttgtagatgtacaggttgcccggttgcccattactgatcatcgacacgaagttctcggttcctgacccagccagattgaacacggtgttgggcaggtagctcgggacgtgtgcggagacatcctcagcggacttcacgttactcacgtcttggatcgcgtagtaacgcttgagggatgtgtaggaggcccgaggtgcagcgaagtaaacgccacgaccaatcccgaagggacgggcaccgtcagagacatcgaactcagtcgtcaagtccaactcaatggtcttcgaggagagaaccccagcggacgacaatacgaactgggcttggtccgaccacaacagcaactgctcagcgaacggaacggcatacttcaagatactcacacggttatgcgagatcgctacgtcaatcggatcgtcatcgctaagagcgctcacggaggccgggaagaagttgaagtatttagcggtcctcgacatgatcacgttctcgcctgcaatgaagcccagacggttacggaagaagaagatgtcgttgatgcgatcaccaatgaatgacggcattgggttggttccatcgtcaccacactggcgcgtatcccatgtcagcggggtccaatcaaagttgccatcagcggcccggatgagggcgtgaggcatggtcgcactattgaacccagcgatgatccccggcttcgccacttccttccagaccttaccagcgaggctgtattggacccagtagttgtcacctgtgcgagcggactcgccagtgacttccacgaggtatccatcaggggcctgagcgggcaacttgttgaacgtctggacttggtagatgaagccgttcatgagctggtcaccgtagccatccttggtctggagtgaaacaaacccaccggggccgggagcggtgatcatgacccagccggggccagaggttgccgaccagcccgaggcgttgagcgcagtgttgatctgagcggccatcgttgaggcgatccagttggcgtccgtcatgtccacttggttcatgccagcgtaaggctgcccagcaggcaccttctcagcggaaccgttaggcatctggatgttcccgtagacgcccccgttgatgaggatctgcatggtccggccatactgcccaccacggatgttcacaagcccccgagtggtcacgttaggttgcccagcgccagtcagcgtaccgcccaactgagtgacagtcttacggttggtcacgaaggtgtagtcagccacggtgatcagcctcaggtcatcccgagggttcgcacagttggcgtagccgttgtaaccacggaccagatactcattgccagctaagtcgtgaaccgtaaggccggacccgaagaacgacacgaagtattgctcggtggagtcccggttgatcatgtggaccagaggcttcacgcccagtgcgccagtgctgtacagacgcttgatgatcttggtcggtggtcgcttctgtagaccctgagtctccgaggaccaaccattgatttgcatggcaccttggttggagaaacgcaagatgtccggttgctgcgagatacctcctttgaggttcttgacgctttgcgaaacgagtcccataggccctccttagcggttggtgataccaccgacgaacgcatcgcctgtgatcatgttgaagccaccgaagtccagctcgtactcttggatggatgcccaagcctcagcctcttgttcctgcaaggagccctcgatctcaccagcaccgaagaaccgggtttggaatcgacgagaggacttagcgacgatgtacgagcggaaacactcgggcatctcagagagttgcttgaggcggatcaggtccacggtgattgggttttcaaagacatcagtcttcgcggtgcggtcgtaaacaaagccgccacggttgatgtacaaggtgccgcctgaggtggtcatgcgcaggtagtcaggcaggtactcaatgagcttcgagaaggcgtcagggagaaggatcgcgccctcctcaatgttgaacgtccagcccttcgcttggatctcacggttgaccttggagagaatgcgacggcagttcgctacgtcagcgttagggtcaccttcgagggaacttacaggggactcaccgatggcagcgagcatgtcattgacagcatcgagttcgtcatcagagtcgaggaccgattcataggccatgttgatctcctttcgttgaatgaaaaaaaaccccaaggagcccggttaggagccccaaggggttagttggctttaggcagccggggtgaagaccagcgcaccagcagcctcaggacgcaggccaccgtgacccatcgcgtacttgccgatgatctggtcagcttggtactcaggacgacgagcgcgttccagcgccatgtctttcagcttcacggtgccgacagccgaacggtgaaccagcaagccgatcacgttgttctgagctaccttgacatcgccagcagcagtggccgggaaggcgtgcttctggttagtgccgaggtcgtcatcaccagcaccgccagcgaccagatgtgggacttcgataacttcccagcccatcacgttgcggatgttgccggtctctgggtcgatcagtgccgagtagttggcagcgttcggcatcagagcagacaggatcgcgctgtagtcgtcaggggaagtgaagaagcgacggtcgccagcagggacgtagttcttggtgaagcggccacgggccagagtcagacctttcaggatcgctttaccacgagcctcaacgtcaacgaggtcagcagcagcaccgatgttcagaacaacggcagtgcccagaccagcgatgttctcgttggtagcggcaggcaggttgcacaggttcgccatctcggccagtacagcaccgtcagcggccagagccagagcttcgcccagttgtgccgagtattcagcacggacatcgtagtggttcatcgcgtcttcgatgtcgtagatcagaacgtccgaggtcaacagaccgtcgatctggatcactttctcggagtgcttgatgtctttacgcttgtcgtccaggttctcaccagcagcgaggtagtaacctttggtacgacccataacagggaacgaagcggacttaccattctggatggtacgaaccatatgcttgtccatggtcacggagcgacggacgaaagccgtcaggacttcgccaccgaacagcttaaggaagttcgccagtttgtcagcagggttctgacctttaccttggttcgcgccgagttgttgaccgccattcatgttcgccatgtattagttctcctttgtgaaattcttaagggcgcaagagatcctccgaagggaatcggataggtatctctcgcaatagtgagggtttattaattaccagttggtgcgcagcactcgggcttcgacttgggcacgataagatgggtcggtagcgtaacgggagtctcccatcgcctttaccatctcggcctgagacgcatagccttgtggaccctgaggggcctgtttaggaccacttgcaggggcacgcttagtgacgctacgttctggtgtcttgccgaacttcttggtgcggctcgccatgcccagattgatcagcgtcttgatggacgcaaggtcttggttctggatggctcgctccaatgcttcaacagcatcaggggagttggccgtcatgtgagccacgatggctttgaacttctcgggaccaccagcgtattgctggatctgggccacataggtttgagccagtgcttcttgaccgctgataaacgacttcacgaagccacggctgtagccaaccttctccagcgcctttaaggacgcctcagagagtttgttgtcagcttcatactcggcctcgatctggtcagcgacctcttgtggcaggcccgctttgatcgcttgagcgcgcatctgagtgaagccatcagcgtactcatcgacggcctcagaggcttcgatcaggtcagcgtcaggttcgcccagaggaacgaactcatcggagtcagcaccttcgtccgtgccctcctcgttcgtcaattccagctcttgagagttgtcctcgccggtatccagttgcagctcgttggagccttcttcggcgtcctcgtagtgcatctcgatggagtcatcgccatcacgaacagacacgggcattgccagcatcgcttgctcatgctcggtgatgttggtagtggtcatcacagcgctattcacgccgaagtgtgcatagacgtcagcttgggattcgttgctcattgggtctcctttagaaaatggagagacacacgcctcgggcactatccgaggtttcccagatgtacttgcttggcagaacgtgtgtctcgcaatagtgagggtttattaaatcggggccgcttcgatgcccgtagtttccatagcgccttggatggcctctggacttgcggtcgcttgttgagcgagaccctgaccgatgccagcagcggcgttgaggccaccttgcttgagcatctcttgggattggagctgagccttctcggcctcagtgagcagcagaccggacgtgtcgatgcctatagcgttcgccagtctcaacttgatgttgctcatgttgaggtctggatcagcctgtagctgactcacgttagccattgcgctcaagaactgattgagcttgtccaagtcctgaccacgacccagtgcctcgacaccagtgctgacagttggctcaacggcctcctttggcatgtctgggatctgcgaggttgcctgtagttggttcaacaggatgcggacgattggtagctggagttcctgagagagaatcgaatagacgcccccaagggtgtcctcaagttcactcgccacatagcggatctcctcggcagtcacacgttcgcccttgcgttgtaccgcagagttcaacatgaagacgtaggagaggcgttgctcaatggcgtcagcgacagacttagcgactgtgaagtcagcggtcttctccaactggaggaactcgatgtcggacttcttaccggcaacaaagtcaccagtctgagccttcaccaaacgacgaacctgagtgacaccgttagggttcaccagtccgatcaccttcgaggcgaccatcgagaacttgatcatggcctcatggagagactcaagggagttcaggtcaccgaggtattcctcgacatgagagcggccataatgctcgccatcacgtttggtccagcgcacagcgatccacgggcaggcatccagaggatactgaccttcggacccatcgacttcgacaccatccacttcctgataagaagcgaactcaccagactcatcgtccagataaacatgggtgtagacctcgatctcttggtcaggcttgcgctcgccatcagcgccaagagagttgcgaacgtcctcagggagagccgcaaaggcgaccttatccacggtgacgatctgtaagacgttcccgaaggcatcacgctggaccacatggttgtggagcgtgtagagcttcatcgggttgtacgcagacgacgatgcgtctggtggtggcaggtagatcagagcggaccctgcaagggccaactggcggatcagctcaaagagcgtcacacggtacgagttggcttccatgtaggacatcaggattcgctcaaccatgcccaagccttgttccacgacagccagttgcgaagggtcggagaccagttgcttcgcttgccattcggacaccttgagcttcatccagctttgcagcgggaatagagccaacatgaccttggcagacaggttgttgagcccacgagcgcccactgcttgccacggagtggagtagtcagtagaggcgttgtcggagtctttagggaacagcgaggggatggtgaccttcgcgcagttttcagcacgggtctcgtagggaactcggtcgtttttcagccgttcgtaaacagcctttgcgccctcctcagcgagcccggtgcgagttgtagtcgccacgggtcacctccttggttagatgttgatgccagtaccagcggaacgagccacgctcagaccacgtttaccacgcgcacgggcagccttcttggcagcctcagtgtcagcatcatcggagccctcagtggtatccttcggggcctccacgacagccgctgagacaggcgcaggggcagccacaggggtcggtgcagcaggggcttcgactacctgagcaggtgcatcattaccgccagttgcttccttgatcacgccagccgggtcagcgactttaacgacagccttggtgaccttcttgacgacctttttaattttcttgcccatggatgttctccttcagttgtttgtaattgatctcgtagcgacccacgcctaagcgcttcgtgtacgccacggtcttgtagccagcattggaggccagcctaacgattgcccgaaggatcattcgacccacggggccacggtggtccgggtgaacccagtgccattgcgttccgagacactcacctacatggtcatcctcatcattgacgaccacagcgaaccccacgagcttcccttgcgggtctctcacggtgatctctatgcgttcgtcaagttcttcggttgaccggcagatgcgctcgtagcattcgactctggacccgccccacgtcagctcagtgagttcctcaaggatgtcgctcagcacctcacggaagcaggccgggtgaccttccttctggacatgcgcagccaggttcacttagtgaccttcttgagagccttcttgatggatgcagcaggcttggacttcttgatggtcccggtgcctgtatcagcagcgacagcatcagacgaaccatcgccagtgtcctttgtggaaacatcggacttcttgaccttgagaccatcgagaccctcatcgctggaggtgtcatcgtcctcggttgagccgaagtccacgcctttaggttcctcaatgagaaccggctcaggcgctttcacagcatcagggttggtctttggggtcttgaccttggacttgaaacacatggtcattcctccttgtttagttgagcctcctgcatcagctccacgatctcagtcgccccatggcatccgtcaatgaagcccatgatgtactgctcggagaaccccgctttgcggagatcatcgacagcaccagtggagatcagataggaagcgttgagacggacgttgagatagtcggcagatgcgggagagatgtcagggatgtcatccgggttttggatgtagtgttggatctgcttgagcaataggactccttaagggaacactgggctccctctcgcaatagtgagggtaaattagggacgccagaggattggcttcatggtctccatatcgaagtccgaagcgcggcagatgcgagccacttgggcttggaccaccaactcctcctcagtcattccctgcttggcagcgagcgacaccatgcagtcccagagggactcgccatcgggctcacgggaagtccagaacggaacctcctcgcctttacgtttgccggacttcatgaccttcacgtcttggaagtagaacttcggagactggagccaatccatcaggccaccatcgaactcaccaccgactcccggtacgccaccatagccatccgtggtgtcgcccttgagggtctgatagaagtggtgcaggtccgaggttgcctcatcgttcttgatgagttcctgctcggtcagccagaagaagtatcccggcaccgtgttgaagtccttgtcacagctcacgccgatcacacggtcacacttaacgatgctcgggtcagtcatcaggacgccacaaacatcgtcaccttcgacaccatgccacttgagggacatttcaccgtagtgcgccatgatctcatcgcagaacttgcggtagcccacaggcttacgcttgcccttacggttggccttataggtctcaaggacatccttacgccagttgtcgtcaccgctcaggatgcagatgtccacgaactcgtacttgtcctcagtgagcttgaacttgcgcttgagttgtgcggcgatgttcgccttgatggtcttgatggtgccgaacagaatgtcacgggctttcttgtgatcgcagaacagggtccatacgtcttcgccccagtcctgctcctcctcagcagcggacatcgctgagaagatgaggtagtccatatcatgggcgaggcccactttcagtttactcaaacggcacctccatattgtgcgaggaagtcttggccggaagtggtcaaggtccagagacccatgttcttaccggcagttgataggcacgagatgtggcctcgggatgaagcctcgttgaccagcgcaatgcgggaacgaacgaagtcgctttgatacgacctcgcttgctttttgatttcccagagaacctttaggtactcattcataccgtctcagtccaacggggaccgggctcacggacaccagtgcgcttgttgtcgcagccagcgttagtgttccgctcggccatcacgcagttggtctcaatgcagccctgacaggaacgcttaggtggggcctcgtaggtcaccttgatgcagcccagccgagcggtcgattcgttgccggtgatttcctcgaccagttccttgcggatcagctcacggatgccagcacggtagatcagctccatcacttgctcagtggtacggtcaccacggaacagctcagcgcggaacttggtctcacccttgagcttttcgatctcctcagcggggatcttgcgggcctcctcacgggtttcgtcgaaggctttcagggtctcggtctttaccacgatggtcatcgggaaggacacgttcagtttcagagtcatgctcataaggatctccttagtgacactcgcgccacgttgggccgatcttggaatcggtagccagtgggcagcggaatttgaatgattcgcctaccagtcggatggcctcgttggagacctttgcgaccagctcagcgatttcttggttgcgacaggcgatctggagttcgtcgtgaacccacgccatgaagcagaagtcaccggggttgccatcgtcgtcgtaccagccatgaacaaggccatgctcctcgacgagaatgcgttccacctcgacgacccacttcttacacacaagcgcaccagcggactggagcagcgagttgagcgcagagtgtggggagcggacatggatctttcggccatcgagacctttgatccaacggcgcttccacttgatgtcgtacttcttggtgacgttgttgtacttctgctcggagatcagttgctcctcaagggctcccctcaggccggagatggccggggtgttctccatgaacgccttcttgagtgccttgccttccttcttgccaccaccaacgaacgacccaacgagaccatcaccagcgccatagaggaacgcataaatgaacgtcttcgcggtgtcccggtaggcgtcatgttcatggttctctttgtcacggattaggccaggaggagcgatgccagcagcgagcgcattgacccagtggatgtcaccgttcaacacggtctcggcatacgaaccttcgtcgaatggcgcaccgaagtgacccagacagcgcagctcaaggccagaggcgtcagtccctaactggacggcgttctcccagcccttcttgagcttcctcgcaaagaccgccccaaagagcgcacggcacgcaggtccgtacttcttcttggcgctgggcacttggcccatgttcgggtggctatgggtcgcacggcctgttacagccccgttggggttcactgagccatggatgcagccatcctcacggacgtatcgcagccacgctttgtcgccctcagagagcatcccaatgaccttggtgacctccatgaactcacgcacaaggttgatgcacgcttgcttcttagggtcagccacacggacgaactcaagggtctcatcgtccatcttggcagcgcccgtgttggtcagctcggtcggaacccagccagcatcacggaggactttctcaaggtgcgcccgagatccggggttgaacgtgaccagttcgattggcgtgtaagggcagccctcgaaggtctctcgggtgtccttcttgccgctcttgaggaacacgccaccgatcttgggatagaccaccttcggcatgacacggccatccgaccagtagtcgattggtgcgccagtcttcgggttgaggaactgcgacttaccacctttcggagaccaccacgacccgaaggtctggatgagttccacgaggagatcgctacgacgacccgccagctcacaatagagcttctcagctccctcgatgtcgaaggggaagccattgcgttccatctgggccagcgaccacgcagccgcatgttccaatcggatggcctcaatggcctcgccttgatcgttgaagtagtgcaggtcggagatgatcttgcggaacaacttcgaggtaacccgaacgtcctgctcacagtagtcctccatggactcggagcattccagccactccataccgtcaacgtagacgccaccatcgttctcaagctggaccttgaagtcatgcttgtattcacccttcatctcgcccagacgatagccccacgcctcaagggagtgagagccaaacatcttgccgggaaggatgcccgaacgcatgagacccgagtcacgatcaccaacgttggagtaaaccagacgggtcatcacgagggtgtccatcacgcgcttccttgggatgttcaaacgcttaccgaagtagagacgcttgagcttgtcgaggaccgggatgtcgtacttgatgaagttgtgcccaacgatcataccgtcaggcttggcagcttcggcctcaagggcagcgatgtactccttgaaggtggactcgttgtaccgaacatattgcccggtgaaatagtcctgaatagtggcgcagtggaaccgagtgacggactcatagagcccgttcgtttcgatgtcagagatgagcatgaggccctccttagttggagaaggcgacagcgctcaaaggcagccatacgacttctgggcgatacgggcgcacgttgaagtgaaacagcacggcatagccggtgtactcctcggagcggtgatagcggatctcgatggcgcggaacaacttgccagcgaagtgaggaccaaaggcgaatgacgccagttggctattggccgggatcttggcgcactggacccggaagtccttgcctaccattggcgcaacgaggtgccagttcggaccccttgggtcgtccttaatgcgggccttgatgtcagcgtcaaccttctcagcgatcatcttgttgagcgcctcaaggattgggtccatcgggtttactggggcttcccaatgtgggtgatgcccagccttctcgatgtacgagtagcccagcttttcgagtacctcagcggcctgctcaccacgtttgatgaacttgcgaacgtcagaaccattcatatgtattcccccctgtagcattgatgtgtgaactcactaaaaggcccctcaaagagaggcccttggatcagctcacgcgcttgatgtcttcgtgtttccatttggcttgcacacgttgatcgacggtggtttgcagggcgttttgagcagccgtgatggcagccttcaaggacgcttcacgagccaccaaacgagcgtgacgcttctcttgaatgcggccagccagagtgatcaggaaagttacgatgtcgaagttcttcatggtttggttctcctttaaaagtcgggttcttgctggtctgcccatgcagcatcagcggcgtcagttgcatcttggtcaggtcgccagccctcaggcttcgctaccaatcgaccagtccgcttgtcgtattccatgtagccagccacgcccgtctcgcccgtgaatcgacacttgaggagtcggaacaggatgaggttagggttggcaccttgttggtttcgctctacagcgatgatggtgtcgctcagttggcgcagaccaccggacccacgcaggtcggtagcggtgacaggtcggccttcctcatgaggtttgcctttgtccgggttcttcaagtgacagataacgaagacgacaacgttcttggtcttggcgaagctcttgagcttggtcatgagccggtcgatcatcttgcgttcatcgttctcaccgtccatcgcagagaccacgattgagatgtggtccagtacgatcaccttgcagccgttgacttcgaccatgtacgccagtcgtgccaataggcgatcctcagcggactcagcgaaggcgtcatagaggtgcagcttgtcgctctcgaagatctcgtcgaacgccttatcgaacatctcctcggtggtctcatcggggttctgacgaactcgtgatcccatgtggagccctacgatgtcctgtacggtttcctcaacggcctcctccagcatcgccacgcctacgggaatcccgcagtcattgaacaggttgtaagtgttctggcgaacgaaggtggacttgcctgagccggacccagaggtgaccagaacgacctcaccttctcggatgtccttggtcatcttgcggagttcgtaaggagccacgagtggataactcgggaccgctttcttctccttgatgcgggccttgagggacttcgcagagaccactccatccggtacgaatggggcagcgttccacatggcgtccatcacagctttggcctgggagttctggagacactcgttcgggtctttgaaaggcaggactgcgatcttgaccttgcccggtgggagaacctcagcggcttcccttgaggcaatccgtccgggctcatccatgtcaaacatgaggatgatctcgtcgaactgatcgaagtaggcgtagttggccgcacaggtcgccttggcagccttcgagccatgcccaatggacacgaccggatacttaccaccttggatctgggccaccgtcaggcagtcgatctcaccctcggtgacgacgatcttgcgaccaccgttccacaggtgccgaccgaacagagcgtccttgtcgtgcttgcccttggtgaagaagtccttgttggcttgacggcacttctgcgacttgaggttgccctcggtgtcgtagtagttggctatctgtaccgggacttccttgccctcatgaggcgagaacgccttgccgatccagtaaccatagaggcggcagattggctcctgtaggaacctcttagggagcgccgagaagtagcctccagcctcgcccatcgagagcgtgccgtcagctttgagcctcggtgtgaactccccacgctccttcccatcgggtgccttgtaggcagtctcagggggacacgcaaagcagtattggtgaccatcagagaacagcgagtttgcatccgacgacccacattcctcacacgggatatgcgcaaggaaaacgctttcttcgcgttcctcatgcgacgacatcggccacctcgatctcatcgacgtaccgaccatcacgcatcggtgccttgtgaatcaggtccagccacttggcttccatcttttcagcacgggagccacgagcgtcctctcgcagttgaaccagattggtccaagcgtgagcgcccatgaagcgaatggttgccccttcgatgcccctttggatgcccgagatggcgaactgattgaggttgtagtcgaacttctggatggcctcggtgacacactcgacctcgtaaagaatcacgtcgatctcgcagccttcgattttccagacaccttgcagccgatcagagtcggagccggtgtggtacttggggaacttgtggtaggtgtagccaccttcatcgagcgctctggaaacagtctccgggtcggtgcccgcgcaaatgatgtcgatgtctttaggctcaaccgagaagaacaggtcacgggcacagccaccagcgataatcgcgccgatgccacggtcaatgagatgctcacaaaggtcgaacccaccttgcagtaaggaacgattcataatgacctcctaaagtcaacgtttaaaaacaacaaagccccaccaaccgaagtcagtgaggccgtgtcgcaacagtgagggtttattaaatcccttgagttttcagccactcggccacgtcgaaggacgggcaggctttacccgagtcgaggtcgcggtgacccacgatcttggcttgcggataggtgcgcttgtgagcgatcagcagcagcttgagcgagttgaattgctcaggcgtgaagttgttctctggggcgcccttggcgttgatcccaccaacgaggcagatgcccagcgaggtggagttgtaacccttggcgtgtgacccaatgacgtcatgagggcgaccatcctcgacagtgccgttacggcgaatgacgaagtgatagccaacgtccagccagccttgttgaacatgccactggcggatctctcgaacgccgatgtccatggtcggtttggttgccgcgcaatggaccacgagcagggtcgtacttgggcgtttcttgaaagcagcctttggcatcatttacctcctttcggatggagtatccccgctgggatctccttacgtttctcctgtagccatgctttaggaatgagtttgtctgcgaacatgatcccgtgcttcgtgcagaagtcggcgtagctcgttggggagcccttatagatcttgctcttggagttcgagaagaccagacggatgtcaaggtcagggtattgctcacggatcagcagatgctttttccggtcgtccacttcccatatccctttggtctccacgatgatcccgttacgcagaacgaagtcaggtgtgtacttggcctcacgggccggaacgacgtacttaatgtggtactgctcgaagtcgaaagggactccgagcttgtccatgtgagccgcgttgcggtcttcaaggccggatcgaaaagcgcctgtacgagcgcccttcgggccagcgtagccagccatcagaagtccgaggcagcgtcaggaataacctcgccagcgtggccttggtcttcgtgatcgtcccagctttcttcacgctctggagcgacgtagccttcttcggtttcgtcagcccagtcgtcattgccagcagcgtactcgaccagtttgatcagcatcacgctatccagttgcagcttgaccgaggcaccgacaacggcaccgaaggtgtaggcaaacatggagaagcgaaccttcaactcggaaccaccagagatcgcaggaacagcgtcgatgcgcttgcccttggcgtccacgaccttcaaggtcagcggcttggtctctttggtttccttgtcttggtacgaggcgtagctggagaacttgaacgtcacggtgccatcgtcgttctcgaagaacggcaggtcgccctcatagggttccagcagtttcttaccacgggccagcttggcggtcagcgatgcgcggttcttctcgaagtcctcgcagattgccgcgtagctttgttcctgcatacgaacgatgcggtcgatgattggctgggcatcagcacggctcacggtcaggttgaccttatagacgccacgagggttgccgaagcctttctctgggttgccgtagtccggcttttggatcgagcagtaaggttcagctacgcctttcggggtaaagaagaactgcttggtggattttgccatcgggattatctcctatgaaagtgggaaggtaggtgtctcgcaacagtgagggtttattcagtacgagagggattcacgctcggtgaacagggtctgcttgaaggtctcaatgaccgggatcagcgtcaccttggtcatcgcatggacgacctcacggaagttgttcttgaggaactccttggagaaccgccagcagccgtgtttgaagtggtgcagctccttgccttccagctcagcggtaacgatggcgcgctcaatgagcagcccttcgaccaactgacgttgatgggcgtcaaggatgtggatgtagaccacgccagccatccccgcgtgcttggtcacggtgaagttctggatgtggaggaagccgtcaggcatcgagcgggtgttgccttgggccaggttcattgagtgacctccgggcggatgcgccgaacgttgtcttcaccgtactcaaggtcagcagcttcgagcgcttcctcaatggtgcggccatacattggcacctcttggacctccttgcggtactccacggtgacgaggaacttcttcattttctggtcttgcttaggcatgagtaattactccttgagttctgagttggtcgatcatctccgaggcgtggccccacttgttcaccacaacggcgtccatttggaagtcacgcagttcaatgtcagtagcgtggagcggctggtcatccacagcagggatcgcccagtctcgggagagacgaacgaggtgcgcttggcggatgctcagtgctgcatattcgttggcttgacgcatgtcagtgacgaccacgagggcatccttgggagccttcttgatctccttgagaccctccagcagccacacgtccgggttctgcttgtagttgcgacggaagccggtgccgtattgctggaggtgccagcgaggtgtccttgggatctcaatgtcgaggatctggggctcattcagcagccagtccttgtactcgctctcagggatcgcctcgattgccaactcctcgaactgagcgtccttgaagtcggtgtgcatgtggctctccataacgatgcgttggcattcgtcgagggccagcatgtggctgcattgcttcttgaggacatccccaaaggcgacccggtagacccggtagccctcgatcatcagaagctcgcacagagtgtctttgccgctacgaccacgctcagaagtcagggcgatgatgtcagtcattgacgatctccttgatcttggtccagaggttcttgaagaacgtcttggtgcgctgccagaagtcggcctttggcgctggtggtttaggtggacggatgttgaaccgggcgcagttgcgttgacggtcgatgttcgattggtgcagacggtaggcgaacgaacggtctttaacgggcatcgtttggatctcctttcggtggttggttgggtgtctcgcaacagtgagggtttattaatcctcgtcgtcgtagaggcgctccacgggagtccggtcaggctcgaagccagctataaggatggcgaaggtgatcacaacgaaaactatcatgaggaacttgatcatagatttctcctattcagacaggcacaaaaaagccccaccgaccgaagtcgatgaggctcgtttagttactctttgatgagtggatcgctgataccacggaactcgtcgaagctcgggtgacgcatcgacccatcagggtagcgttccatgcaggtgactcggaccatgtggtggtggtacgggttctcagagtcaaccaatgagctgcccatcccgtagatgatcgactcgatgtcctcaacgtcataaccgttgtggtccatcactttcttggtgaactcctccatctgggccttactgatcttgcaagcgttgaccacatggccggactcaagttgaacctcgaagccgatcacctttccctcgttggctttacccttcgagccccagaccagaccaaccaccttgccgtcctcgttgttgctcggcaccttcttccaccagccgttgcacttcgagcggcgatagaagcccatcggatctttgaccaccaaaccctcctccttacgctcacgcaccgaggtgtagagctggaccagcgagagtggcggttggagctttacggtgatctcgttgccctcctcgtcgaagccttcacgctcaaccactggcatggtctccactgagaagacctcgtaggactcagcggcgatccattggatctctgggaagtattccttgagcttggctacctgatactcaacgtggatcttacggacgcactggaagacctcgtattcctcaccgctcagcacaacgtccattggtacgatgtcgaagacgtagacccggatgcggctcagcgggatcgactcctctttacggcgcagggtgcccgaggtggtcttgcagggaacctcacggtcatccatgtcggtcaggaccagctcagcgtccaacatgaacccttgagggaacatcccctcgcctttgttctcgttgaagaagtcagcccagcgagggtcggtgtccagaggaccatgagatggcccgaaggccgggaagcgcttaccctcacgggacaaccactcgacttcccaaccgtggtcatgcttggtctcgatcaggttcacgcacaggttcaaacgaacgccgtccttcttgacatcagcgatcaggtaggactcatccagaacagcctcaacagccttctcgttgtagtcggttgggcggaatggcttggtgttcaggataacggcttcgactttggacatggggttccccttagttggattcggtagtggtggttttaggcttgcgaggagcgcgggttttcttcaccggctcagtcacaggttcagcctgggcctcatcgacgatcatcacgtcagccttgacgccttgcagttggctcgaagggaccgcgctcacgtcagtcacctcagcgggcttcttaaggatgttcatcagggtcttaaagtgcgcctcaacggagcggatggtcacagcctcggcaccgacccgaagggcttcgatgcgagtctcaaggtcgccactgagaaagcggttgtccatcagctcttgaacgtcatagccagtcttggcggtggtcgtaacgtcaccgatggtggttgaggtttcgatcaggatcaggtcgtcaactttggacgaagtggcggtaacgataacttgcattgggatctcctaaggttgggaattagtaggcagcgttgccggtgcagattggggtccactctacgcgaccaccacggacgggcttgttgcgcttgcccttcttggtgcggatggcttccatctcggagtcatcacgcagggtacgtttggtggtcttaacgaagttctgagcggcgttcataattggtttccttatgcgaaggcgaagtcggatttgaggatgtcgcggatgttgagcgttcccatctttggaagctcaggcatcttgtccagttggctctcgtgtagttgctccatgaattgctcacggaagtcagccagcacgttgttgttctcgtaggtttcgaccatggtctctcggaccgcccggaacatcgcgccagctttggcagggatggtgccgaacgagtcgtggatcagggcgaagaatcgaatcccgtggttgtcgtaaccgtgtacgactgtcttgcgaaggtgcgagccgtcttggctgtgaacaaagttcggagagatacccgactcttgcttccttgcgttgatcttgctggacccgttgtcgcgcatcatcacggtggcttggatgcgaacgtccccgaggaacatgaggtcgattcggcgcgttgggttgatcgtgtattgctgccataccgggaacccatcaggggtcgtccagtagactggcatggcaggcttgaggatctctttggtcttcttgcacttgacctcagaggccagcagcttggcggccttctgtagccagttcattgcttccacagcggcgaccacaacaacactcaccgagtcccagattttgccagccatgtagcggctcgcttcaccggggcttgtgaacatgtggccctcatcgttgtcgatggccttctttacgatgtcctctcggacttgatcagcgaacccgtaggctttcgacccgtaggccagcgtcattacagaccgcttggtgaccttacgagacatcccgtaagtgagccacgcaatggcgagggtcttagtgccgagacgcttaacatcgcggatctctccagtgacctcatcgacgagagtttcgatccagtcgtccgtcccgtacttgaggtcatattgcagagcgatctcgacttcatcagagacgatcttgtagatgtcttgaacggagtccgaagggatgaggttgacagcacgcccaccacgttcatctcgaagcatcgcggaaaagtgctggatgccagaacaggaaccatcgaacgcaaggggtagggcactgacgtgtgcagcgccattagctttaacgccagcccactcaaagcagaaagcgaggaagcagaatggggagtccatggacatccattcggtgacgttgaggggatcgttggcaatcgccaagataagttcttcatggtctcggacccattgtttacgttcaggaaagggcaccttatcgacgcccgcagtgttggccccgtgaatcatgagccactcgattccttcctcacctacaggttccccatgggcagcctgcaagatccctttggtcatgtcgttagactgagggttgaaggcagggaccgcgtagacccggccacgccaatcgaggttgtacgggaagtagatcgcatcgtactcagcaaacttgttggcttgctccagtccgaactcgtaggccaatcgacgggacacccttgcggcgtccttacggtagaccccagcggcctccttcttccacgccttgagagcgtctgggttggtgtcgatgtcgtggggttttagtggcagctcttggcgttccgttgtggggaactccttgatctgtacgttcttccactccatcaccgcattggcgacctcaaggacgcgcttattgactgcccaagcggttgactgtgcgatgttgactgcccggtaaaccgcaggcatctcgacatcccggtagcgctctcgggcttgcttgccgttgagtcggatgaaggtcagaggcttgcgacccttggcccagtaaccgccaccttgcagacccttccacggtttaggcggaacgatgcagggttggtactgaggcgtgataccggccagtgcgaaggcccggttctggatcttgtcagcccattcatccttgaggaacacatactcgccatcgttcttcttgtccccagcgtgatcacggcgaacctcgatcagttgggtcgattcgatcaacagctccagcattcggatgcccatgtggaagcggacatctgagtcagcgacgttccagtcaacccatggttgggccagttcgcccttctgtagcatcgactcctcgacccgctccatgtacgccttcttgtaggtcataccgttgcgcttggcgagagccggggcgatggctcgcttgaagtgttcggcctcaaggactcggatgcggccaaagcgcgcttcgtcttcgagggctccaccgaccacgatgctcatctcggtcaccgttggggcaccattacggcgctgggcgatcatgttgagaacgtagcggatggtcacagcggccatcgtgtccgggttcatttgctgtgcagcggcgaagctcacatgtttacggccacgacccttgttggcttggtggtcgatccatgcggtgatcgcagcggacatcttagggaccagagtgcccagcagcggctgagcggcgatgttgttggagaactcaccgcgctccatctggcgctccatctggcgatgaaagcgttcctctccaagcgtgtacgcttcgtgttccaagcgcagttgctcagcggccagttcggggccgtagatgctggagagttgattgaaggcgaatgaggatgttgcgatgtcagcgaagtcgtgacgctcggggatcattctttaagatgctctatgagatatagttgtcttatagaattgctctataaggtttatctcagagggatctttaagatgtctttaaggtgatcttttaggcaggaaccctctgaggtgtctcgcaacagtgagggtttattaatccagccttacttaaccacctcgatccggccatgaacgtcggccatcttgtagacaaatgtcttgagttcgaggtcatcgttccacttcgtgatagcggagtaatacttgctgatctggtctcgcagttcggccacttcggagtcctcaaggagaccctcaggcttgaccgcatcaccatgggtggtctcaatgacatcgacccattcctctttgcgccaccagagcatcccggtgactcgcagctcttgccgcttgagggtcacagcaggccggtaggtgcgctctaagcgctggtgccgctccagcttccacttggcatcgcattgaggctcattgagcagctcagggcttcgtgaccactgcttgatcgtcagtaggtcatcagtgatggcaactcccaggctgacaacgtgacgaccacaaggcccaaggcccagctcaaaggtcagctctttagccttgacgagcccgtaggtgttcggatcgacccacgaggcgcggaacttgatgagcttggcgcgctgggtgtagtcgctgggtggcgaaggaatcattgaggggcgcttagagaagccacgcatctcagaaccctccccgatagcagcgagtgaagtccccacggtcgctgtagcgcaggccggggcacaacataccgcccaccacttggcgagcttccatggcactcaggaacgcctcagtgaagtccttgcggcgtccgtaccagtagccaaaggcgtccttcccggtgcgaacggtgttctttgaggtgatgattcgttggtcaatgagccccggctttcgaggctggtaattcgtgtgcatcacttaacttcactccagtggaccagtagttgtcggcagccttcggtgacaggcaggccgtagtgcagggtcgttttacccttgaagaacatgccccagccgggttcgttctgagggaccatcacgtcagggaagaaaggcccttgagcagccatcgtgccgccccctacatggtcatcgttgagcgccactaccagagtgacgtcagagtcccggtcggtgtgccagtggcctcgtggagtctctgagggctcatagcgggcagcctgtacactggtcaggttctcaggctcaaggttgaacagcaccttggcgtaggcgatcccagcgtcagcccagaaggaccggaagacctcgaacagcaccttgtgttcatcctgcaaggtcacctcagggatctgcgcctcaaggggctcctcaaggttgggctcgaagacgaacttgcccatctcgtgcttgatgtcgcggcagtagcccggatgcaggtaggcgaccgagtagatccccggtgcatggcagaccacgcaatcgtcaaggaacttttgccacgaggaggactcagagaacttgctcgggttgatcccgccgttgtcctcagcgtatgcggccatctccttgagggtctcaagatgctcacgcagaaggggatggtacttgtcaaccgatgcgatacccgtggtggccttagtgaga

SEQ ID NO: 5 - DNA, 41241 bp, unidentified
  misc_feature 1..11: note = bacteriophages nucleic acid sequence
  source 1..41241: mol_type = genomic DNA
atggcaaaatccaccaagcagttcttctttactccgaaaggcgtagctgaaccttactgctcgatccaaaagccggactacggcaacccagagaaaggcttcggcaaccctcgtggcgtctataaggtcaacctgaccgtgagccgtgctgatgcccaaccaatcatcgaccgcatcgttcgtatgcaggaacaaagctacgcggcaatctgcgaggacttcgagaagaaccgcgcatcgctgaccgccaagctggcccgtggtaagaaactgctggaaccctatgagggcgacctgccgttcttcgagaacgacgatggcaccgtgacgttcaagttctccagctacgcctcgtaccaagacaaggaaaccaaagagaccaagccgctgaccttgaaggtcgtggacgccaagggcaagcgcatcgacgctgttcctgcgatctctggtggttccgagttgaaggttcgcttctccatgttcgcctacaccttcggtgccgttgtcggtgcctcggtcaagctgcaactggatagcgtgatgctgatcaaactggtcgagtacgctgctggcaatgacgactgggctgacgaaaccgaagaaggctacgtcgctccagagcgtgaagaaagctgggacgatcacgaagaccaaggccacgctggcgaggttattcctgacgctgcctcggacttctgatggctggctacgctggcccgaagggcgctcgtacaggcgcttttcgatccggccttgaagaccgcaacgcggctcacatggacaagctcggagtccctttcgacttcgagcagtaccacattaagtacgtcgttccggcccgtgaggccaagtacacacctgacttcgttctgcgtaacgggatcatcgtggagaccaaagggatatgggaagtggacgaccggaaaaagcatctgctgatccgtgagcaataccctgaccttgacatccgtctggtcttctcgaactccaagagcaagatctataagggctccccaacgagctacgccgacttctgcacgaagcacgggatcatgttcgcagacaaactcattcctaaagcatggctacaggagaaacgtaaggagatcccagcggggatactccatccgaaaggaggtaaatgatgccaaaggctgctttcaagaaacgcccaagtacgaccctactcgtggtccattgtgcggcaaccaaaccgaccatggacatcggcgttcgagagatccgccagtggcatgttcaacaaggttggctggacgttggctatcacttcgtcattcgccgtaatggcactgtcgaggatggtcgccctcatgacgtcattgggtcacacgccaagggctacaactccacctcgctgggcatctgcctcgttggtgggatcaacgccaagggcgccccagagaacaacttcacgcctgagcaattcaactcgctcaagctgctgctgatcgctcacaagcgcacctatccgcaagccaagatcgtgggtcaccgcgacctcgactcgggtaaagcctgcccgtccttcgacgtggccgagtggctgaaaactcaagggatttaataaaccctcactgttgcgacacggcctcactgacttcggttggtggggctttgttgtttttaaacgttgactttaggaggtcattatgaatcgttccttactgcaaggtgggttcgacctttgtgagcatctcattgaccgtggcatcggcgcgattatcgctggtggctgtgcccgtgacctgttcttctcggttgagcctaaagacatcgacatcatttgcgcgggcaccgacccggagactgtttccagagcgctcgatgaaggtggctacacctaccacaagttccccaagtaccacaccggctccgactcggatcggctgcaaggtgtctggaaaatcgaaggctgcgagatcgacgtgattctttacgaggtcgagtgtgtcaccgaggccatccagaagttcgactacaacctcaatcagttcgccatctcgggcatccaaaggggcatcgaaggggcaaccattcgcttcatgggcgctcacgcttggaccaatctggttcaactgcgagaggacgctcgtggctcccgtgctgaaaagatggaagccaagtggctggacctgattcacaaggcaccgatgcgtgatggtcggtacgtcgatgagatcgaggtggccgatgtcgtcgcatgaggaacgcgaagaaagcgttttccttgcgcatatcccgtgtgaggaatgtgggtcgtcggatgcaaactcgctgttctctgatggtcaccaatactgctttgcgtgtccccctgagactgcctacaaggcacccgatgggaaggagcgtggggagttcacaccgaggcttaaagctgacggcacgctctcgatgggcgaggctggaggctacttctcggcgctccctaagaggttcctacaggagccaatctgccgcctctatggttactggatcggcaaggcgttctcgcctcacgagggcaaggaagtcccggtacagatagccaactactacgacaccgagggcaacctcaagtcgcagaagtgccgtcaagccaacaaggacttctttaccaagggcaagcatgacaaggacgctctgttcggtcggcacctgtggaacggtggtcgcaagatcgtcgtcaccgagggtgagatcgactgcctgacggtggcccagatccaaggtggtaagtatccggtcgtgtccattgggcatggctcgaaggctgccaaggcgacctgtgcggccaactacgcctacttcgatcagttcgacgagatcatcctcatgtttgacatggatgagcccggacggattgcctcaagggaagccgctgaggttctcccaccgggcaaggtcaagatcgcagtcctgcctttcaaagacccgaacgagtgtctccagaactcccaggccaaagctgtgatggacgccatgtggaacgctgccccattcgtaccggatggagtggtctctgcgaagtcccttaaggcccgcatcaaggagaagaaagcagtcccgagttatccactcgttgctccttacgaactccgcaagatgaccaaggacatccgcgaaggcgaggtcgttctggtcacctctgggtccggctcaggtaagtccaccttcgttcgccagaacacttacaacctgttcaatgactgcgggattcccgtaggcgtggcgatgctggaggaggccgttgaggaaaccgtacaggacatcgtagggctccacatgggatcacgagttcgtcagaaccccgatgagaccaccgaggagatgttcgacaaggcgttcgacgagatcttcgagagcgacaagctgcacctctatgacgccttcgctgagtccgctgaggatcgcctattggcacgactggcgtacatggtcgaagtcaacggctgcaaggtgatcgtactggaccacatctcaatcgtggtctctgcgatggacggtgagaacgatgaacgcaagatgatcgaccggctcatgaccaagctcaagagcttcgccaagaccaagaacgttgtcgtcttcgttatctgtcacttgaagaacccggacaaaggcaaacctcatgaggaaggccgacctgtcaccgctaccgacctgcgtgggtccggtggtctgcgccaactgagcgacaccatcatcgctgtagagcgaaaccaacaaggtgccaaccctaacctcatcctgttccgactcctcaagtgtcgattcacgggcgagacgggcgtggctggctacatggaatacgacaagcggactggtcgattggtagcgaagcctgagggctggcgacctgaccaagatgcaactgacgccgctgatgctgcatgggcagaccagcaagaacccgacttttaaaggagaaccaaaccatgaagaacttcgacctcgtaactttcctgatcactctggctggccgcattcaagagaagcgtcacgctcgtttggtggctcgtgaagcgtccttgaaggctgccattacggctgctcaaaacgccctgcaaaccaccgtcgatcaacgtgtgcaagccaaatggaaacacgaagacatcaagcgcgtgagctgatccaagggcctctctttgaggggccttttagtgagttcacacatcaatgctacaggggggaatacacatgaatggttctgacgttcgcaagttcatcaaacgtggtgagcaggccgctgaggtactcgaaaagctgggctactcgtacatcgagaaggctgggcatcacccacattgggaagccccagtaaacccgatggacccaatccttgaggcgctcaacaagatgatcgctgagaaggttgacgctgacatcaaggcccgcattaaggaagacccaaggggtccgaactggcacctcgttgcaccaatggtcggcaaggacttccgcgttcaatgcgccaagatcccggccaatagccaactggcgtcattcgcctttggtcctcacttcgctggcaagttgttccgcgccattgagatccgctatcaccgctccgaggagtacaccggctatgccgtgctgttccacttcaacgtgcgcccgtatcgcccagaagtcgtatggctgcctttgagcgctgtcgccttctccaactaaggagggcctcatgctcatctctgacatcgaaacgaacgggctctatgagtccgtcactcggttccactgcgccactattcaggactatttcaccgggcaatatgttcggtacaacgagtccaccttcaaggagtacatcgctgcccttgaggccgaagctgccaagcctgacggtatgatcgttgggcacaacttcatcaagtacgacatcccggtcctcgacaagctcaagcgtctctacttcggtaagcgtttgaacatcccaaggaagcgcgtgatggacaccctcgtgatgacccgtctggtttactccaacgtgggtgatcgtgactcgggtctcatgcgttcgggcatccttcccggcaagatgtttggctctcactcccttgaggcgtggggctatcgtctgggcgagatgaagggtgagtacaagcacgacttcaaggtccagcttgagaacgatggtggcgtctacgttgacggtatggagtggctggaatgctccgagtccatggaggactactgtgagcaggacgttcgggttacctcgaagttgttccgcaagatcatctccgacctgcactacttcaacgatcaaggcgaggccattgaggccatccgcttggaacatgcggctgcgtggtcgctggcccagatggaacgcaatggcttccccttcgacatcgagggagctgagaagctctattgtgaactggcgggtcgtcgtagcgatctcctcgtggaactcatccagacctttgggtcgtggtggtctccgaaaggtggtaagtcgcagttcctcaacccgaagactggcgcaccaatcgactactggtctgatggccgtgtcatgccgaaggtggtctatcccaagatcggtggcgtgttcctcaagagcggcaagaaggacacccgagagaccttcgagggctgcccttacacgccaatcgaactggtcacgttcaaccccggatctcgggcgcaccttgagaaagttctccgtgatgctggctgggttccgaccgagctgaccaacacgggcgctgccaagatggacgatgagacccttgagttcgtccgtgtggctgaccctaagaagcaagcgtgcatcaaccttgtgcgtgagttcatggaggtcaccaaggtcattgggatgctctctgagggcgacaaagcgtggctgcgatacgtccgtgaggatggctgcatccatggctcagtgaaccccaacggggctgtaacaggccgtgcgacccatagccacccgaacatgggccaagtgcccagcgccaagaagaagtatggacctgcgtgccgtgcgctctttggggcggtctttgcgaggaagctcaagaagggctgggagaacgccgtccagttagggactgacgcctctggccttgagctgcgctgtctgggtcacttcggtgcgccattcgacgaaggctcgtatgccgagaccgtgttgaacggtgacatccactgggtcaatgcgctcgctgctggcatcgctcctcctggcctaatccgtgacaaagagaaccatgaacatgacgcctaccgggacaccgcgaagacgttcatctatgcgttcctctatggcgctggtgatggtctcgttgggtcgttcgttggtggtggtaagaaggaaggcaaggcactcaagaaggcgttcatggagaacaccccggccatctctggcctgaggggagcccttgaggagcaactgatctccgagcagaagtacaacaacgtcaccaagaagtacgacatcaaatggaagcgccgttggatcaaaggtctcgatggccgaaagatccatgtccgctcccctcactccgcgctcaactcgctgctccagtccgctggtgcgcttgtgtgcaagaagtgggttgttgaggtggaacgcattctcgtcgaggagcatggccttgttcatggctggtacgacgacgatggcaaccccggtgacttctgcttcatggcatgggttcacgacgaactccagattgcctgtcgcaaccaagaaatcgctgagctggtcgcaaaggtctccaacgaggccatccgactggtaggcgaatcattcaaattccgctgcccactggctaccgattccaagatcggcccaacgtggcgcgagtgtcactaaggagatccttatgagcatgactctgaaactgaacgtgtccttcccgatgaccatcgtggtaaagaccgagaccctgaaagccttcgacgaaacccgtgaggaggcccgtaagatccccgctgaggagatcgacaagctcaagggtgagaccaagttccgcgctgagctgttccgtggtgaccgtaccactgagcaagtgatggagctgatctaccgtgctggcatccgtgagctgatccgcaaggaactggtcgaggaaatcaccggcaacgaatcgaccgcccgactgggctgcatcaaggtgacctatgaggccccacctaagcgttcctgtcagggctgcattgagaccaactgcgtgctggctgagcggaacactaatgctggctgcgacaacaagcgcactggcatccgtgagcccggtcctcgttggactgagacggtatgaatgagtacctaaaggttctctgggagatcaaaaagcaagcgaggtcgtatcaaagcgacttcgttcgttcccgcattgcgctggtcaacgaggcttcatcccgaggccacatctcgtgcctatcaactgccggtaagaacatgggtctctggaccttgaccacttccggccaagacttcctcgcacaatatggaggtgccgtttgagtaaactgaaagtgggcctcgcccatgatatggactacctcatcttctcagcgatgtccgctgctgaggaggagcaggactggggcgaagacgtatggaccctgttctgcgatcacaagaaagcccgtgacattctgttcggcaccatcaagaccatcaaggcgaacatcgccgcacaactcaagcgcaagttcaagctcactgaggacaagtacgagttcgtggacatctgcatcctgagcggtgacgacaactggcgtaaggatgtccttgagacctataaggccaaccgtaagggtaagcgtaagcctgtgggctaccgcaagttctgcgatgagatcatggcgcactacggtgacatgtccctcaagtggcatggtgtcgaaggtgacgatgtttgtggtgtcctgatgactgacccgagcatcgttaaatgtgaccgtgtgatcggtgtgagctgtgacaaggacttcaacacggtgccgggatacttcttctggctgaccgagcaggaactcatcaagaacgatgaggcaacctcggacctgcaccacttctatcagaccctcaagggcgacaccacggatggttatggtggcgtgccgggagtcggtggcgagttcgatggtggcctgatggattggctccagtctccgaagttctacttccaagacgtgaaggtcatgaagtccggcaaacgtaaaggcgaggaggtcccgttctggacttcccgtgagcctgatggcgagtccctctgggactgcatggtgtcgctcgctgccaagcagggaatgactgaggaggagctggtggtccaagcccaagtggctcgcatctgccgcgcttcggacttcgatatggagaccatgaagcccatcctctggcgtccctaatttaccctcactattgcgagagggagcccagtgttcccttaaggagtcctattgctaaagcagatccaacactacatccaaaacccggatgacatccctgacatctctcccgcatctgccgactatctcaacgtccgtctcaacgcttcctatctgatctccactggtgctgtcgatgatctccgcaaagcggggttctccgagcagtacatcatgggcttcattgacggatgccatggggcgactgagatcgtggagctgatgcaggaggctcaactaaacaaggaggaatgaccatgtgttttaaatccaaggtcaagaccccaaagaccaaccctgatgctgtgaaagcgcctgagccggttctcattgaggaacctaaaggcgtggacttcggctcaaccgaggacgatgacacctccagcgatgagggtctcgatggtctcaaggtcaagaagtccgatgtttccacaaaggacactggcgatggttcgtctgatgctgtcgctgctgatactggcaccgggaccatcaagaagtccaagcctgctgcatccatcaagaaggctctcaagaaggtcactaagtgaacctggctgcgcatgtccagaaggaaggtcacccggcctgcttccgtgaggtgctgagcgacatccttgaggaactcactgagctgacgtggggcgggtccagagtcgaatgctacgagcgcatctgccggtcaaccgaagaacttgacgaacgtatagagatcaccgtgagagacccgcaagggaagctcgtggggttcgctgtggtcgtcaatgatgaggatgaccatgtaggtgagtgtctcggaacgcaatggcactgggttcacccggaccaccgtggccccgtgggtcgaatgatccttcgggcaatcgttaggctggcctccaatgctggctacaagaccgtggcgtacacgaagcgcttaggcgtgggtcgctacgagatcaattacaaacaactgaaggagaacatccatgggcaagaaaattaagaaggtcgtcaagaaggtcaccaaggctgtcgttaaagtcgctgacccggctggcgtgatcaaggaagcaactggcggtaatgatgcacctgctcaggtagtcgaggcccctgccgcaccgacccctgtggctgcccctgcgcctgtctcagcggctgtcgttgaggccccgaaggataccactgagggctccgatgatgctgacactgaggctgccaagaaggctgcccgtgcgcgtggtaaacgtggtctgagcgtggctcgttccgctggtactggcatcaacatctaaccaaggaggtgacccgtggcgactacaactcgcaccgggctcgctgaggagggcgcaaaggctgtttacgaacggctgaaaaacgaccgagttccctacgagacccgtgctgaaaactgcgcgaaggtcaccatcccctcgctgttccctaaagactccgacaacgcctctactgactactccactccgtggcaagcagtgggcgctcgtgggctcaacaacctgtctgccaaggtcatgctggctctattcccgctgcaaagctggatgaagctcaaggtgtccgagtggcaagcgaagcaactggtctccgacccttcgcaactggctgtcgtggaacaaggcttgggcatggttgagcgaatcctgatgtcctacatggaagccaactcgtaccgtgtgacgctctttgagctgatccgtcagttggcccttgcagggtccgctctgatctacctgccaccaccagacgcatcgtcgtctgcgtacaacccgatgaagctctacacgctccacaaccatgtggtccagcgtgatgccttcgggaacgtcttacagatcgtcaccgtggataaggtcgcctttgcggctctccctgaggacgttcgcaactctcttggcgctgatggtgagcgcaagcctgaccaagagatcgaggtctacacccatgtttatcttgacgatgagtctggtgagttcgcttcttatcaggaagtggatggtgtcgaagtcgatgggtccgaaggtcagtatcctctggatgcctgcccgtggatcgctgtgcgctggaccaaacgtgatggcgagcattatggccgctctcatgtcgaggaatacctcggtgacctgaactcccttgagtctctccatgaggccatgatcaagttctcgatggtcgcctcgaaggtgatcggactggtgaaccctaacggtgtcactcaggttcgtcgtttggtgaaggctcagactggtgactttgttgccggtaagaagtccgacatcgagttcctccagttggagaagaccgctgacttcacagtcgctaagtctgtcgctgatgccattgagcaacgcctctcctacgtcttcatgttgaactctgcggtacaacgcaagggcgaacgtgtgactgccgaggagatccgctatgtggcgagtgaacttgaggacacccttgggggcgtctattcgattctctctcaggaactccaactcccaatcgtccgcatcctgttgaaccaactacaggcaacctcgcagatcccagacatgccgaaggaggccgttgagccaactgtcagcactggtgtcgaggcactgggtcgtggtcaggacttggacaagctcaatcagttcttgagcgcaatggctaacgtgagtcagctacaggctgatccagacctcaacatgagtaacatcaagttgagactggcgaacgctataggcatcgacacgtctggtctgctgctcactgaggccgagaaggctcagctccaatcccaagagatgctcaagcaaggtggcctcaacgctgctgctggcatcggtcagggtctcgctcaacaagcgaccgcaagtccagaggccatccaaggcgctatggaaactacgggcatcgaagcggccccgatttaataaaccctcactattgcgagacacacgttctgccaagcaagtacatctgggaaacctcggatagtgcccgaggcgtgtgtctctccattttctaaaggagacccaatgagcaacgaatcccaagctgacgtctatgcacacttcggcgtgaatagcgctgtgatgaccactaccaacatcaccgagcatgagcaagcgatgctggcaatgcccgtgtctgttcgtgatggcgatgactccatcgagatgcactacgaggacgccgaagaaggctccaacgagctgcaactggataccggcgaggacaactctcaagagctggaattgacgaacgaggagggcactgacgaaggtgctgactccgatgagttcgttcctctgggcgaacctgatgctgacctgatcgaagcctctgaggccgtcgatgagtacgctgatggcttcactcagatgcgcgctcaagcgatcaaagcgggcctgccacaagaggtcgctgaccagatcgaggccgagtatgaagctgacaacaaactctctgaggcgtccttaaaggcgctggagaaggttggctacagccgtggcttcgtgaagtcgtttatcagcggtcaagaagcactggctcaaacctatgtggcccagatccagcaatacgctggtggtcccgagaagttcaaagccatcgtggctcacatgacggccaactcccctgatgctgttgaggcattggagcgagccatccagaaccaagaccttgcgtccatcaagacgctgatcaatctgggcatggcgagccgcaccaagaagttcggcaagacaccagaacgtagcgtcactaagcgtgcccctgcaagtggtcctaaacaggcccctcagggtccacaaggctatgcgtctcaggccgagatggtaaaggcgatgggggactcccgttacgctaccgacccatcttaccgtgcccaagtcgaagcccgagtgctgcgcaccaactggtaattaataaaccctcactattgcgagagatacctatccgattccttcggaggatctcttgcgcccttaagaatttcacaaaggagaactaatacatggcgaacatgaatggcggtcaacaactcggcgcgaaccaaggcaaaggccagaaccctgctgacaaactggcgaacttccttaagctgttcggtggcgaagtcctgacggctttcgtccgtcgctccgtgaccatggacaagcatatggttcgtaccatccagaatggtaagtccgcttcgttccctgttatgggtcgtaccaaaggttactacctcgctgctggtgagaacctggacgacaagcgtaaagacatcaagcactccgagaaagtgatccagatcgacggtctgttgacctcggacgttctgatctacgacatcgaagacgcgatgaaccactacgatgtccgtgctgaatactcggcacaactgggcgaagctctggctctggccgctgacggtgctgtactggccgagatggcgaacctgtgcaacctgcctgccgctaccaacgagaacatcgccggtctgggcactgccgttgttctgaacatcggtgctgctgctgacctcgttgacgttgaggctcgtggtaaagcgatcctgaaaggtctgactctggctcgtggccgcttcaccaagaactacgtccctgctggcgaccgtcgcttcttcacttcccctgacgactacagcgcgatcctgtctgctctgatgccgaacgctgccaactactcggcactgatcgacccagagaccggcaacatccgcaacgtgatgggctgggaagttatcgaagtcccacatctggtcgctggtggtgctggtgatgacgacctcggcactaaccagaagcacgccttcccggccactgctgctggcgatgtcaaggtagctcagaacaacgtgatcggcttgctggttcaccgttcggctgtcggcaccgtgaagctgaaagacatggcgctggaacgcgctcgtcgtcctgagtaccaagctgaccagatcatcggcaagtacgcgatgggtcacggtggcctgcgtcctgaggctgctggtgcgctggtcttcaccccggctgcctaaagccaactaaccccttggggctcctaaccgggctccttggggttttttttcattcaacgaaaggagatcaacatggcctatgaatcggtcctcgactctgatgacgaactcgatgctgtcaatgacatgctcgctgccatcggtgagtcccctgtaagttccctcgaaggtgaccctaacgctgacgtagcgaactgccgtcgcattctctccaaggtcaaccgtgagatccaagcgaagggctggacgttcaacattgaggagggcgcgatccttctccctgacgccttctcgaagctcattgagtacctgcctgactacctgcgtatgaccacctcaggcggcaccctgtacatcaaccgtggtggcttcgtttacgaccgcaccgcgaagactgatgtctttgaaaacccaatcaccgtggacctgatccgcctcaagcaactctctgagatgcccgagtgtttccgctcgtacatcgtcgctaagtcctctcgtcgattccaaacccggttctttggtgctggtgagatcgagggctccttgcaggaacaagaggctgaggcttgggcatccatccaagagtacgagctggacttcggtggcttcaacatgatcacaggcgatgcgttcgtcggtggtatcaccaaccgctaaggagggcctatgggactcgtttcgcaaagcgtcaagaacctcaaaggaggtatctcgcagcaaccggacatcttgcgtttctccaaccaaggtgccatgcaaatcaatggctggtcctcggagactcagggtctacagaagcgaccaccgaccaagatcatcaagcgtctgtacagcactggcgcactgggcgtgaagcctctggtccacatgatcaaccgggactccaccgagcaatacttcgtgtcgttcttcgggtccggccttacggttcacgacttggctggcaatgagtatctggtccgtggttacaacggctacgccaactgtgcgaaccctcgggatgacctgaggttgatcaccgtggccgactacaccttcgtgaccaatcgtaagactgtcactcagttgggcggtacgctgactggtgctggacaacctaacgtgaccactcgtgggcttgtgaacatccgtggtgggcagtatggccggaccatgcagatcctcatcaacgggggcgtctacgggaacatccagatgcctaacggttccgctgagaaggtgcctgctgggcagccttacgctggcatgaaccaagtggacatgacggacgccaactggatcgcctcgacgatggccgctcagatcaacactgcgctcaatgcctcgggctggtcggcaacctctggccccggatgggtcatgatcaccgctcccggccccggtgggtttgtttcactacagaccaaggatggatacggtgaccagctcatgaacggcttcatctaccaagtccagacgttcaacaagttgcccgctcaggcccctgatggatacctcgtggaagtcactggcgagtccgctcgcacaggcgacaactactgggtccaatacagcctcgctggtaaggtctggaaggaagtggcgaagccggggatcatcgctgggttcaatagtgcgaccatgcctcacgccctcatccgggccgctgatggcaactttgattggaccccgctgacatgggatacgcgccagtgtggtgacgatggaaccaacccaatgccgtcattcattggtgatcggatcaacgacatcttcttcttccgtaaccgtcttggcttcattgcaggcgagaacgtgatcatgtcgaggaccgctaaatacttcaacttcttcccggcctccgtgagcgctcttagcgatgacgacccgattgacgtagcgatctcacacaaccgtgtgagcatcttgaagtatgccgttccgtttgctgagcaattgctgttgtggtcggaccaagcccagttcgtattgtcgtccgctggggttctctcctcgaagaccattgagctggacttgacgactgagttcgatgtctctgacggtgcccgtcccttcgggattggtcgtggcgtctacttcgctgcacctcgtgcctcctacacgtccctcaagcgctactacgcgatccaagacgtgagcaacgtgaagtccgctgaggatgtctccgcacacgttccgagctacctgccaaacaccgtgttcaatctggcggggtcaggaaccgagaacttcgtgtcgatgatcagtaacgggcaaccgggcaacctgtacatctacaagttcctgtacctcgacgagatcctccagcaacaatcgttctcccactggaacttcgggaccaacgttaagatcctcgctgcgtactcgattggctcctacatgtacctcatgttggatcgccctgaggggatcatgatggagcgtattgagttcactcagtccaccatcgacatcgctcaggagccctaccggacctacatggaccagaagaagctcatccagatcggtgcctatgacatcgacctccaccgtagcttcgtgagcatcgagtccattctcggtggtctgccacatgctgactccgtgttctacacgattgaccagcaaggcgtgatgcagcggcacgagggaccatggccttcgggctctggcttgtcctttccgggcaaccgggctggtgagtatgtggtctttggtcgtgagtacgagttccaatatgagttctccaagttcctcatcaagcagaccgctgacgatggttccacctccactgaggacatcggtcggctccagcttcggagagcatggttgaactatgagaactctggcgcgtttgagatcaacgtcaacaacggctccactcagtacgtctacccgatgtctggtggtcgcctcgggactcaaacgttcctcggtgagctggctctggggaccgggcagttcaagttccctgtcaccggcaacgcccaggcacaacgagtgacgatcagttctgcaaaccctaacccactcaacatcatcggatgcggatgggaaggtaactacattcgccgttctggcggtatctaatcgactggcatggtggggggtttaatttaccctcactattgccctatgggggatctttatgattttacagaaagcacaacgctggcacctcgaagctgctgcacgagacctcagtcccggtgacctccaagagttccactcccacacggctgggcgcgacccacgagacaccatcccgaactgcctcgatgacacctcaatggtgatcactaaaggcgctctggtggtggctgtaggtgggtccaaagattgcctctggtttgtgactaccaacgtggtggacctgctgaccaaggctgaacgtatggagttctatcggatgctcaaagggcatctgagcgtactcaggctgcaaggccatcaatccctgaccaacttcgtgtcagtggacaatcacgcccacatccgtctcctcaacgctctcggtgcgaccttcgcccgtgaacaccacatgagtcctgccggatgtcggttccgtcaattctggctataggaggtcaccatgtgtgaaccagtaagcatcggcatggctgctgttgcggtcgtcggtggggctatggctgccaaggacaaggccaagggtgagggtaacgctgaggatgctcaacgtcgcaccgcccgagagcaagtcaagcagaccaacatggctaacgccaacctgcaactgactgcccaagaccgccaagaggaggcccgagcgcaactcgctgaggtcaacatgcaggcgctcaagaacaaaggaacggtggctgctgccatcggtgagtcaatgctttcgggcaactccatcaagcgtattgcgaactcagtggatgtcgaggccagtcaacaaaagatggcgatcaccgacaactacaagcgcgactattcgtcgatctttgcgaaccagattgccaacgtcgagaacaccaagtcggccctcaaaggtcaggcccaagtgatcaagaccagtggtctgagtcatgcccttgggatcgtctctgcgggggccaatggctacgccgctggggcatccttgaaaggtcagatgaacgccaacaaggcaactggacaatccaacggtacagctaaaggaggaacttaatggctaatgaaattgcacgagctttagactcggcccaaatgggcggtaaggaacgccttaagggctccactgcgaccgtccagtttcaagcctctcagcaacgtgctgacgtaggcaacaatggcttcgctgactccatggcgagcttcgtgaaggccggggcgaatgcctatggcacctacgctcaggacaaggcgaagaacgctcaggctgagtcggacaagatcatccggtcgatgtccctccagcaacgccgtgaggctatcgcagcgggaaccctgcacctacaggatgaccctgacgtgatgaacgtcctgcgtcacgacactggccggacggctgcctttgaggtggagtccgagatccagaacaagctcgcctctggtgagttcgacaaccaatcccgtgaggaactggatgagtatcgccggacccgtctggagatggtctctcagtcctacgctcaggaagcgggtattgaccctaacgatcctgactaccagcgtggctttaacgccgacatcgtgaagcgtaatgcgggcctattcgacttgcatgaccagcgacgttcccagcgttacattgctcagactgtggtcaacacgcgtggcgacactggtggtcttctggatgaccctgagttcatgcgaggtccgggctctggcatcgagatggctgcctacttcaaatcgaaggcgtcctctggggcaatcccaacggaccaagcgctcctcgattcagtcaacctcgtgatcaacgatgcggtccagaaggaccacggatcgaccttcctcaagaacttccgagatcagacgatcaccgtgatggggattgagcagaaggtcggtgacgtgatcggtcaggagaaatacgacaacctgatcgccaagtccgctgaggccacctacaagcgcaaccaaccgaagttcgagaagttccaactggatctcgcttcggctgaggctcaggctgacccggctcgtggctgggacatgatcaatcggatcgaggccgagaataagtggattcaggatggtgatggcttcactcagcaaaagcaggcggtcaccagtaccaagctcgccatgctggcaaagatgaaggcccacactcaggcgacccttaaggcaaccgaggaggcgatgcagacggacaaccgcttgcaggccatcgacgaccgatacaaggctcgccgtaatggtgccctcttggggaccgctaagcaggacatgcctgtcgatgccaacactggtgagttcaaggagtccgactgggcgacctacgctcaaaagaagctggctcagatcgaggccatggacatccctgtggagcagaaggatcttgagcgcggtcagctcctcaaggacgaccacgagaatggtcctttccgtcgaggcttccaaacgctgatcgacgatgcagccaaggaatggcaaggcgctgttcaattgggcgaactcggggactccccaaagatcgaccaactggcacgggtctatgcccagcaaccggaactcattgcgtcactctaccctgagcgcgctggcttcatcgaaaagatgaaccagatgaagcacgttggaattaacccatcggtcctcattgcggctgacgtgaagaactccaagctgaccaaggaggagatgatccaacggaacatccaatgggatgccctcaagagcgaccctaagaacaaagacctctcagcgattccgaacgacatggacaccatggctcgttctctctatgacgccttcaacgctgcaactggcgaccctacggctgcctccaagttgctctccaactggctctcgaagaacaccgttagcttccaagctggcgatgacgacgaggatgtccagaccggctaccaagggatgatcaacaagaaggatctcatggccgacccgaacgacgttaactcgtgggagcagggtaaggccatcgttgaggagaccgttaagggcatcaaggctgctgacccgtactgggctgactcgcctgtgaccatcaccgcttcccgcactggtgacatcaagatcgccaccttgactggtgaggtcgtgaccatcaagaagcaatccctccagctcatctacagcgctcgccgtcaggcggaactggaagctcagaaggccaacaaggctgctgagtacgatgaggacgtgaaggacgcacaacgcaatcaaggtctctacaaagactttatccgagggggtcgtggccctctctaatccaatttaggaggaacacatggctaagaaaacctacgctgatgtcaaggccgctggcacgccttacgatggtttgattcgtgaggctgctgatgccaatggcgtgagctatgactacctgcacaaaaagatcttcaacgagtccagcttcaaccctcaagctcagtcaccgactgggcctcgggggctgggtcagttcactcgtgccactggtaaggcgtatggtctcgttacagacgaggacttcttcgaccctgccaagtccatcaatgcgtccgctcgccacactgcggacctcctcaagacctacaaaggggactacctaaaggctgcccttgcgtacaaccaagggaatggccgcttgggcgctccccagttgcaagctctggatcgtggtgacttctccaagatcgcccctgagggtcgtcagtacatggcgaaccttctggacgtggctggtgactccccgtcccgcaagtggttcgagggtccagatgccccaaagctaaccgctgagttccaagaggctacccaagggatctcagcaacaccatccgttgaacaaggtagcctcggtggaaacattgggatgaacatcgggggctccactgcgcctgcccaagagaagtcgttccgccaaatggagatcgagcagaacggcccagagaagggcgcatggtacggctcctctgaggccatgttggctgccttgaagacctcgcttcccggccagatctaccggaacatcaccgtcgaggatcatgaccctttggagtggatgcaggacacgggcgaccgtgagtggtccaaggaggactacgaccacatccgtaatgaaggtgtcgattcgcaatacttcgacttcattggtgactacacccggtacgacaagcgcaagctgcctgaggccatcgctctcgccaaagagaacatgactcacgacaagaccatcacatccgctggatggggcggtcaactggctgctggtggcgttctcgctgctactgatccactgacctacgtccctgttccgggcaccgctctgcgcacctttggtggccgtgtgttggctcaggggacgttctcctctggtgccgctgtggctggtgagggtatccgtgaggcgaccactgggatcgaaggtcactacgctaccgctgctgtaggtggtgctgtgatcggtggcaccatggctgctgtcttggacaagtggattgccaagtcactcgttaagcctgggcgagaagacatgagcgatgaggaactcgaaaaggttcttgctcgccacggtgaggctggcctccagtccaacgatgtcaaagtcgatgaggacatgttggcctccgctcgcccctctaaggttgacgatgagatggacgatgagtacctcgaaaagatcctcgggatgcacggtgagcgatcccacaaacaagagggtcgaatggaagtctctgacgacaccgttgagggcatccttgcgaggcaccgagagtcgagccaaccgaacgagttcatgggtccaaccatccgcatcaatgcccgtgagcaagctcgtttggctggtgctgacgaccctaccgttatggcatggaagtccgatgagacccctgatgaagccttcgggattcagtacatggatcacccaaaggaaccgggcgctgtgcgtctgcctgatggttcgatcctctcggccagcaacccgctgaaccccaagctcatcaaagcgatggcctctctggagcctgagcgagccgctgctgggttcaagttcggcggactgactgagattggcctgatgctgctgcgtagcgaggacgaggagctgagaggtattggcgctcagttgttccgctcgcccactggtggtgtctctgggtccaacggtaagtttggcgctgtggcttctgacgtgatcgagcgtgagcgtggtcaagatcatgtggctctaaacgccatggtcgatgcccaacaagaggccatgaaggatgtctcggtgaagaccctacccggtggccgtcaggctcagcgtgagtatgtggatcgccggatcgctgaggctatcgaagaccctacagggaccaagctggctcagctcactgaggccgagaagaagtacgccaaggtagtcgaggatcactttgtccgcaaagagaactcccttgagaaccctgcgcagtacggcaacatggatgccacttcgatcatgcctcagacccgtcactctggccggtacatcccgaacatctacgatgacgccatcaagctgctcaacctccaacgcttcggcggcccggagggtttgcagaaggcaatcgttgagagctggatggcttcctatctgagccgtgctgctgtgaaaacccgagtggacaagatgatcaaggagtcgctggaaaagaacggcaaggtggcaacacctgaggacattaagaaggctgtcgtcgagtacgcctacaacaaggcatacggtatcagccacacgactgacttcaaccgctcctcgctgatcgacgataacctcgaaggtctggtgggtcaggatgccaacaacttcctcgaaggtcgtcacctgtttgactcggacgtggctgtatcgctgagcgatgggacaaccttctcggttaacgacctgcgtatctttgacgttcctcagatcacctcctcgtacaaccgtcgagtaaatggggacatcgggatcatggctgcaactggtaaggacaccactgccctcaaggacgcgatcctcaagatcaaggccaagaatggcaacactcaggaagtggaagccttgcaggagtccatcaagctactcactgggcgctcacgtcgagaccctgactcagcggctgcaacactggctcgtgccttgactgacgtttcgttcttcaccaagaacgcctacatgggcgctcagaacgtcactgagatcgctgggctgatcactaagggccacactcggatgctcatgaagggagtcccattcctccgtgagatgaccacatggggctctaagatcaaacctgagcaactcaaggagatgcacgacatgatcttcggtcgggagctggatgacctcatccgtcctcgccgtgctgacatcgtgcaacgcctgcgtaaccaaggctacagcggggccacggctcagactgtgggcaccatcaagttcgccactggtgagctggctgcccgttcgcctttcaccaagttcctcactgagacctccaactacatcctcgatgctggtcggcaaggtgtccttgtggacctcgtgaaccatgcgctctctgggaagacctcgaagctgttcaatgaggatcgactgcactcgatgtcgatcaccaaggctcagttcggtgacgtgacgaatgccctcaaggagcatctcgtggctgatcccaaaggtggcttcaagatccgtgatcgggccaagttccaacaagaccctcgggtaatggacatctggcggattggtgacaaggtggccgatgagaccatcctgcgtccccacaagctgagcaacaccgatgccattgcgcagaacgcttgggtcaagttggcgatgcagttcaagaacttcgtcctgcgttcggtaaacagtcgcctcctacggggcttctataacgccaccaagaacaagcaggccatcgaccaagcccaacaagtggcgatctcgatgggtctcgcctcgggcttctatgtggcccagcgctacgtccaagctcaagggatgcctaaagaggaacgccgtgacttcctgtcgcggtcactggacatgaacatgatcgcttatgcagcgggctctcgtagctctcacgttggtgcccctttgggtatcgccaactttgctctggcccctctggggttcgatgctgctgctgctgtgcggacctctgttctgcctcgtggtcctcagtacaccgaacggaaccgggctgtgaaatattccccgctccgctcctcgggcatccaagacccgctctcgaagttcgctgagcaagtacctggcctcggagtcctcgggtcgatctatcagattggcaatggcaccgctggcgtgttccgcgatgaaggtcgggctcaggatcaggactacaagtctgcgatctacaacgggttccgtaacctcgtgccgaacgaccctgcaactcagaaggtcaccaacatgcttttccaagagatgggcatggagtacggcaagcgcggccagaaggtccgttaataacccctcactattgggatacatcaactcacgccctgccctaacccggtggggctttttcattaaggagaccacatggcaactaccaccaagacggtgaagacgtatgccctcaacggttccctcaaggacttcacgattccattcgagtatctcgctcgtaaattcgtgagtgtcaacttgatcggcgcaacccggaaagagcttgtactcaacgtagacttccgcttctccactccgaccaccatcaccaccttgcgtggttctggctggggtccggctgacaacttcgacctgatcgagatccgccgttggacttccgccactgagcgtctcgttgacttcgctgacggttctatccttcgtgcctacgacctcaacaccgctcagattcaatcgctccacatcgctgaggaagctcgtgacctcacggctgacacaatcggcgtgaacaacgatggtcaactcgatgcccgtgcgcggcgtattgtgaacctcgctgatgcgatcaaccccggtgacgctgtgaccctgcgccaagagcaacaatggggcggctcagcgctcaaccaagcgaacctctcggctgcctctgcggctgcctctcaggcttcccggctggcttctgaaagtgcccgcgatacgtccatcacttacgctggcgaatcgtacacccatcgaattgcctcggagaccgctaagaacgcctcggctgcctctgcgacaaactctgagttgtccaatcagactgcctacaagtgggccaacaaccctgagaacgtggtggtcaacactgggcaatactcagcgttccactgggtccagaaggcaatcgcccatgtggctaccgctctgggctacgccaacgctgcctcatcgtctgccactcaggctgcccaaaaggtggctgacgctcaggctcaagtgagtctcgctgctgctcaggcgaccatcgcaaccaacaaggctgctgaggctgctacaagcgcttcccagttgggcggtgcgattggtattggtgacaacatctcgtccacttcgagcggtgacgggaactggaaggtggtctttaagggcatcgtacaggctgtcggtgcgttcttcggtaagcgctttgaggcccagccttacaccgagtcgactggcttttccagccaatggtccacctctgcgcccttcttgactcaggaaggtgtactcgacaacacctcagcttactacccaatcatcaaaggtaagtatggtcaggctggagcaggccatgcgccgtccatgggcgtcctgacgagaaccgatggtaaccacgccttgacactccactggggcaactcagcggggactggcccagcgctgcttcaactgaacaaagatggcctgaacgcctccttctcagggagcatctcatcggggtctactggtgcaatctactcgggtactggtggggtttacgactcaggtaaccgcgtgtggtcaactggtaacttcaacccagcctacaagctgagtggtactggagggaccaacacgatgggtaacaacaatcaagtctgtggcgtcacctacacgaacctctcggctgccaaccaagtttacaacggtgcctttgagatccgtgagaatggtctggtaggcaatggtggaccagctcccggtcacatctacaacgctcctgcgattgccttccactggggcgcgaccgttgtttctaagctgatgatgaacgctgctggttccttgtgctggggcaacccttcctcgcagttcatgcagatctcccaggatgggaacatcttcggttccgttttcggtaaccagtgggcgaccacctacatctacaacaccgccaacgagcgtgcaaacgcttgggcagttcaagaagcccgcaacgtcaacaacatcggcatcgccatgtccagtctgcgagtcaactcgctgggctgccacatgctggctctggctcacaacaactcgggcgtggagtggaacgaaggtgtcgctggcggcaacctcactggcaccaacactggtggcacttacttcgctggctacaacttggccggtaactacgttcggatgggtaagttggttaacgctgacggcgcatcccctgactccgtgaccctatacatgcgctatgcgtaaggaggattaatggctaacagatctatcgtggacgtgaagaatgtccaatggtgctgccctaacaaggatgcagcctactgcctcgtaaagttctcggacatcgaggactacatcgagtacaccgctgtgcgtggcgacgaagttgcgcatggcaatgaactattccagatcatcgaccggggtctcgctggggacatccctgagtatgccggtcctgaccaatcgcagatcgaggcatggaacctgctcatggaggaggtctctgcgcttcgtgtggagttcgacaagatcatccctgaggtccaattgggcctcgctgcacctgagcgtgtagagcgcgccaagtacctctatggccgcatcaaggacatcgagtcgtaccacaaagcgacctatgacctgacgttctgctacgtcaaccgtgaggtgtcctaatgggcatctccattgacttcaacaacggggtcgtgcaagcgactccagtcgtaggtgctgctgtaactgacgtgactgcccggttgtttctgggtctgtcaccaagtgagtggttctacgcatccgccgttttgtactccctcgtgatgactgtaatcgtggtttacaagaccgttaaagaagaacgccgtaaagacaaggaggctgagaaatgagtgatgacttactgatgcgcctgctggtcgcgctggacactgacatggcaaagaacatgttggctgacctccgtgatcctgagcgtagaacgcctcagctctacaacgctgtgggcaagctgctggaacgccacaagttcaccatcgccaagctgcaaccggatgagtcccttctgggcgatctcgcttcggctctcgatgagatccctgagttaactgacgacgagctgtacgcctcggacgttcgccactaaaggaggccctgcatgttgaaccttaaagagttcgtcatgtggggccttttggtttgcacaggcttaggtctgacgtatgccaaaggtcactctgacgcaaccgacacactgaccctcaaacatcaaactgaacaactggcggctgcccgtcaactggaggtggaacgtgaaacaacccaaagagccctcgctgatgtctcgaagaactggcaagcctatctctcaacgagtaaggcatctgctgatcggactattgctggtctgcgtagcaatggtatcagcctgtcagtcgccctcgcagatgccaccgtcaagtgcgtcacggctgacggtagacccctcgctgatggtcgtgccgagctacgagaaagcgatggtcgatttcttatcgaacaagcccaacgagcagacgcccaagtgaagggcctgcaagattccattaagaccatccaaggaggaactaaatgagcgcaccccgtaatgggggcgacgacatagcgttaatgaaaaggtcattcgtggcctttctttttgtcctgtggagagccctcaacctacccaaaccaaccaagtgtcagatcgacatgtccaagaagctcagctctggtgacgaacgtcgattcatccttcaagcattccgaggcatcggcaagtccttcatcacctgcgcattcgttgtgtggaagctgtggggcaacccggacctaaagttcatgatcgtgtccgcttccaaggaacgggcagacgccaactccatcttcatcaagcggatcatcgagctgcttccattcctccacgagttgaaaccacggacgggtcaacgtgactccgctctggccttcgacgtgggtctcgccaagcctgaccactcgccatcggtgaagtcggtaggtatcacaggccagctcacaggttcccgtgcggacatcctcattgcggatgacgttgaggttccgaacaactcgggcacccagtctgcgcgtgacgccctgggagaacttgtgaaggagttcgatgcgatcctgaaaccgggcggtacgatcatctatctgggcacccctcagaccgagatgaccctctatcgtgagctggaaggccgtggctacgtcactactatctggcctgcgagataccctaaggatcagaaggattgggactcctatggcccacggctggctcctatgctggaggctgagctgcgagctgatggttccctgttctgggcaccgactgaccctgtacgcttcgacgatacagatctcagggaacgtgaactctcctacgggaaaggtggcttcgccctccagttcatgctcaaccctaacctcagtgacgccgagaagtaccctctcaagctgcgtgatttcatcgtagggacgttcgacatgatgaaggggccaaccaccctgacatggatgccaaacgccaacaacgaggtcaaaggcgttcctctggtgggtcttaaaggcgaccgcttccaccgctacgaagctgtaggtcaggccactgcgcagtacgctcagaaaatccttgtgatcgacccatcggggcgcggtaaggatgagactggctatgcagtcctgtaccagctcaacggctacatcttcctgatggacgctggtggcttccgtggtggctacgaggacacaaccctccaagccttatcgaacctcgccaagatctacaaggtcaatgaggtcgtgatcgagggcaacttcggtgacggtatgtacctcaagctgattagtcctgtgctgaccgctacatggccgtgcgcgatcactgaggtcaagtccaagggtcagaaggaactccgcatctgcgacgttctggagcccgtactgggcagccataagctggttctcagcgaggccctcatcgacaaggactaccggactgcgctcaacgctgacgggaccacggacatcaagtacagcctgctctatcagctctctcggatcacccgtgagcgtggatcgctggcccatgatgaccgcttggatgcccttgcgattggcgtccagttcttcactgaggccatggagaaggattccaagctgggcgagtcggaactgatggctgagttcttggaggcccagatggagaaccaactgatgggctttgaggacgtcagaaggatcgcaatcagtgactccgtggacatcatgttcgacgatgaaggctcaatgaccaactatatgggctggtaggatgtctgcatgatcgaagcatgatcgacgaagtttatttaccctcactattgggagaggcccaccctaagatacctaagagattcctaacaagatctcagcaaggttcttctggtggtgcctctaacctttgggttcctcaggatgaggtccgaccaaaggaactggaccaaggatggttatcaactatgatcattatcaagaaggaggtcacaaccatggacgtagagaaagccaccgtgctgctcgtactcaagcggttggctctctccaagaccacctacaagctcatcggcaccctgctggtggccttaggtgtcctcaatggcagtgatgtcatgaacatggtctccgacctcgtatgtgtggcatctggtggctgcgtagagtgaccgacacgaccaatttcggtatggttacaccctacctcattggtcagcttaagaaagcccttaggtgtcctcataggcccttagggtcttccttaggataaccgatagatggcacttgcatgaacccattggataccttaggatgtcctttaagaatctgatagaaaaatctgaaagggcacctctcatagacaaacgcccatgaatcccccccatagggcctctctcagccatcctcggggctctgctccccatagggcatctcaatgatcatctgagggatacgatgcggtgactcaatgatgactacatggtggtgatccttaggtggttcgttgaggtacatgatggggcctaaagggtgagctgtcaacactggggattcgtacagtagtccatctgtccctatctgtatcagcaatccttaggctgctccttaggtcactcccagggtgatcatgtgacgcctctccttagggccatccttagggctcctataaggtgcctgtagaccctgctccttaggatggccttgagttgcctatatagaggcgatgcgtagcctatgagttgttacaggctgacctatacactggatgaataaacaggttgacggcgatgctcagttctatacaatgggccacatcaacaacgagacacggcctaacgggtgtctctgagttggtcgcttagcttagtagcatctgacctgcgatcatacgtgtgccaagggtcttaagggtgacgaacgatgagcgacacaagggcagaaacaaacgcttgacaacatcgcaacacgctgtagaatacgcaacatcaacaacgaaacacgcaacgagctacctgagcagatgtcatgagtagggtgggtcgggtgaggtcaaagtcaccagcatgggtcgcaagaagggcaacgaattggccgataactacggcctaacgggcacccttacgctctttaacaactcggactgcaacactacgcactgagacgggctgacgtcttaacgggcttgctcagaccctcggtgcgtagcagtgaaaggaaatacagcaagagggctctcgtgtatctaagcattagcacgggacgtggagagccttcgtctgtatctcttaacacacaagcaaggagcatcaccatgagtacacgcactgatcgtatacgcactgagctggctgacctcgatgcacgtattgtgaaggctgaggctgagcatcaagccgctaaggccatctttgggcgctttgagggctctgctgctcatcctatgtgggagaagctgcgcaatgaggttgactcaacgctgactcgctgccgtgtccttgaggccgtgtggcaccgcactaaggctgacctgctcgaacaactcaacgctgacaaggagtaacaccatggacactggctaccttcaacatggcaaggcaccgggaccattccgcaccgagaaggtgagcatcaagaacgaacacggtgatcgctggcttgccttctatgagggtcgctggcgtcgggttcactaccaagttcatcgcttgttcatcgtgtacaacggtgagcatattaccatcaccatcgaaggtgtctgagcgattcactgtagggccttcattgagggctctatgggaacaactcaacgtcacaccaacaacctgggagcaatcaccatggcactgactcaactcaaaactgacaccaccgagatcgctggcaagacctacctgacccgtcattggtacatggatggtcgcaaggttccgggctctgagcatcacgagatggacggctccgctgctcatcgcacctactacgctcagttcgtcacaccggctgttctccgtgtcgtcaaggctcactttagcaagtcgcaatgggcactcatgggcaatgcctacctcaacggtggtgaccattacctcaatgagtcctcaaggctgcaccagtgggaccaatgcgacatcaagcagatggttggtcgcaccgtcaccgagtgtgcctacagcgatgtccctaagggcaccatgtattggtcaccgagtgagaacacctgcatcaccaaggaagccgctcggatgctcattgagtccggggagtacctgaaatgagcgttcctaccttccgccagatgctctaccgggtgatcattgaggaactcaagaaggagggcatcaagttcgggcaagatcctcacacgctctcctccagtcaatccaacacgctctatgagtgggctcaagcgatgcgctacaagccatccgctacagcctcgctgtcaccgggtcgtcagttctacgtcttcctctcccgtctggagcaagtgcaatgaaaatgaccaacgagcaaatcaaggccaagtatccggccaccgctgagcgcatcattggggaacgtcgagtcctccgtaagctgctcactgcgatcactggctctggctactgcttccgcatcaacaacggcgaggacttcgagaccaaccacacctacaccgtgcaagtgggcattgacgcctgcatggctaccgatgaggaccatgtggtggtctaccgggttcgccctgatgacggcacctaccaacgcatcggcaagttctggctggtctatgggaactccgctgaggaggtcatagcagactacagcgccatcacatcgttcgagtccatgttctccagatggttcgacgaagccaccatagacgccgagtgattcactgatgggccttcgctgagggctcattgggaacaactcaacgcaaaccacataggagatccaaatgatccacgcaatcgctcgccagtccaaaaacatctgcctgttcgctctgttcgctaccgtgatcgccctcggggccatccatgcgaatgacgctgaggcacgaggtttctcgggtagtcggtcgagtagctccagctcatcccgctcttacagcgcaccgcgtaccagctcctacaagcctgcccctcgggtcgtccagaacgtcaccgtcaaccgtaccactgtggtccatcaatcggctccagcggccatgggcggtggctctggtggcttcatgagtaccgtagcgggctcctttgcgggcacctctctggcgaactggtggaacaactccagcaacgaggagaaggccgaaaagcaacgccttgaagacgagcagaagcaacgcgatgaggccgctgcactggaacgcctcaagctggacctgctgattcagcaacaatcgggcaagccaatcgaaggcatgttgccaccgggcaaataagcacctctctacgatggtcaataagagcctgccttcgcgtcgataacagcgcaaaggtgggcattctgtaccgctccatttaccgcacgtcttaggtctttgaattatgcaacgctacaaccgtactaacttcacctcggctgcatttgctgaacgtctcatcgctgctatgcgtggcgctctctctgatggttacgcccactatgtggagaaccggcacgggcaacgctggctccgtgtggacgtaaaacccgacgacttcgggggctacaccttccagttccttgctggttctggtcaagacgttggcagcctgatcttgcaagcctgcttcgtctggtccgaggagcatgagcgagccttctcggggttgttgagcgaattatacacacgttccgaacatcctttgttgaccgctcgtcgtcgtgatgcagaactggaagctgaaagcaagcccaaacctgcaaaaaatcgttggaaatcagcacttaaagagacccttaggtacttgactgcgcttgcggttggtggtggtgctgggcatggactcgtcgcactgggagtgttcggatgagtaccgttctcactaaggccaccacgggtatcgcatcggttgacaagtaccatccccttctgcgtgagcatcttgagaccctcaaggagatggccgcatacgctgaggacaacggcgggatcaacccgagcaagttctctgagtcctcctcgtggcaaaagttccttgacgattgcgtggtctgccatgcaccggggatctactcggtcgcctacctgcatccgggctactgccgcgacatcaagcacgagatgggcaagttcgtcttcgagcccaaccttgaggagccccttgaggcgcagatccctgaggtgaccttgcaggatgaacacaaggtgctgttcgaggtcttccggtccttctgggctgacgctgggatcgcctacgccaaggtgctgttcaaccttgagcctgagaacctgaccagtgtacaggctgcccgctatgagccctcagagactccacgaggccactggcacaccgaccgggactctgacgtcactctggtagtggcgctcaacgatgaccatgtagggggcggcacgatggctgctcaagggcctttcttccctgacgtgatggtccctcagaacgaacccggctggggcatgttcttcaagggtaaaacgaccctgcactacggcctgcctgtcaccgaaggctgccgacaactactggtccactggagtgaagttaagtgatgcacacgaattaccagcctcgaaagccggggctcattgaccaacgaatcatcacctcaaagaacaccgttcgcaccgggaaggacgcctttggctactggtacggacgccgcaaggacttcactgaggcgttcctgagtgccatggaagctcgccaagtggtgggcggtatgttgtgccccggcctgcgctacagcgaccgtggggacttcactcgctgctatcggggagggttctgagatgcgtggcttctctaagcgcccctcaatgattccttcgccacccagcgactacacccagcgcgccaagctcatcaagttccgcgcctcgtgggtcgatccgaacacctacgggctcgtcaaggctaaagagctgacctttgagctgggccttgggccttgtggtcgtcacgttgtcagcctgggagttgccatcactgatgacctactgacgatcaagcagtggtcacgaagccctgagctgctcaatgagcctcaatgcgatgccaagtggaagctggagcggcaccagcgcttagagcgcacctaccggcctgctgtgaccctcaagcggcaagagctgcgagtcaccgggatgctctggtggcgcaaagaggaatgggtcgatgtcattgagaccacccatggtgatgcggtcaagcctgagggtctccttgaggactccgaagtggccgaactgcgagaccagatcagcaagtattactccgctatcacgaagtggaacgatgacctcgaactcaagacatttgtctacaagatggccgacgttcatggccggatcgaggtggttaagtaaggctggattaataaaccctcactgttgcgagacacctcagagggttcctgcctaaaagatcaccttaaagacatcttaaagatccctctgagataaaccttatagagcaattctataagacaactatatctcatagagcatcttaaagaatgatccccgagcgtcacgacttcgctgacatcgcaacatcctcattcgccttcaatcaactctccagcatctacggccccgaactggccgctgagcaactgcgcttggaacacgaagcgtacacgcttggagaggaacgctttcatcgccagatggagcgccagatggagcgcggtgagttctccaacaacatcgccgctcagccgctgctgggcactctggtccctaagatgtccgctgcgatcaccgcatggatcgaccaccaagccaacaagggtcgtggccgtaaacatgtgagcttcgccgctgcacagcaaatgaacccggacacgatggccgctgtgaccatccgctacgttctcaacatgatcgcccagcgccgtaatggtgccccaacggtgaccgagatgagcatcgtggtcggtggagccctcgaagacgaagcgcgctttggccgcatccgagtccttgaggccgaacacttcaagcgagccatcgccccggctctcgccaagcgcaacggtatgacctacaagaaggcgtacatggagcgggtcgaggagtcgatgctacagaagggcgaactggcccaaccatgggttgactggaacgtcgctgactcagatgtccgcttccacatgggcatccgaatgctggagctgttgatcgaatcgacccaactgatcgaggttcgccgtgatcacgctggggacaagaagaacgatggcgagtatgtgttcctcaaggatgaatgggctgacaagatccagaaccgggccttcgcactggccggtatcacgcctcagtaccaaccctgcatcgttccgcctaaaccgtggaagggtctgcaaggtggcggttactgggccaagggtcgcaagcctctgaccttcatccgactcaacggcaagcaagcccgagagcgctaccgggatgtcgagatgcctgcggtttaccgggcagtcaacatcgcacagtcaaccgcttgggcagtcaataagcgcgtccttgaggtcgccaatgcggtgatggagtggaagaacgtacagatcaaggagttccccacaacggaacgccaagagctgccactaaaaccccacgacatcgacaccaacccagacgctctcaaggcgtggaagaaggaggccgctggggtctaccgtaaggacgccgcaagggtgtcccgtcgattggcctacgagttcggactggagcaagccaacaagtttgctgagtacgatgcgatctacttcccgtacaacctcgattggcgtggccgggtctacgcggtccctgccttcaaccctcagtctaacgacatgaccaaagggatcttgcaggctgcccatggggaacctgtaggtgaggaaggaatcgagtggctcatgattcacggggccaacactgcgggcgtcgataaggtgccctttcctgaacgtaaacaatgggtccgagaccatgaagaacttatcttggcgattgccaacgatcccctcaacgtcaccgaatggatgtccatggactccccattctgcttcctcgctttctgctttgagtgggctggcgttaaagctaatggcgctgcacacgtcagtgccctaccccttgcgttcgatggttcctgttctggcatccagcacttttccgcgatgcttcgagatgaacgtggtgggcgtgctgtcaacctcatcccttcggactccgttcaagacatctacaagatcgtctctgatgaagtcgagatcgctctgcaatatgacctcaagtacgggacggacgactggatcgaaactctcgtcgatgaggtcactggagagatccgcgatgttaagcgtctcggcactaagaccctcgccattgcgtggctcacttacgggatgtctcgtaaggtcaccaagcggtctgtaatgacgctggcctacgggtcgaaagcctacgggttcgctgatcaagtccgagaggacatcgtaaagaaggccatcgacaacgatgagggccacatgttcacaagccccggtgaagcgagccgctacatggctggcaaaatctgggactcggtgagtgttgttgtggtcgccgctgtggaagcaatgaactggctacagaaggccgccaagctgctggcctctgaggtcaagtgcaagaagaccaaagagatcctcaagcctgccatgccagtctactggacgacccctgatgggttcccggtatggcagcaatacacgatcaacccaacgcgccgaatcgacctcatgttcctcggggacgttcgcatccaagccaccgtgatgatgcgcgacaacgggtccagcaagatcaacgcaaggaagcaagagtcgggtatctctccgaactttgttcacagccaagacggctcgcaccttcgcaagacagtcgtacacggttacgacaaccacgggattcgattcttcgccctgatccacgactcgttcggcaccatccctgccaaagctggcgcgatgttccgggcggtccgagagaccatggtcgaaacctacgagaacaacaacgtgctggctgacttccgtgagcaattcatggagcaactacacgagagccaactggacaagatgcctgagcttccaaagatgggaacgctcaacatccgcgacatcctcaaatccgacttcgccttcgcataaggaaaccaattatgaacgccgctcagaacttcgttaagaccaccaaacgtaccctgcgtgatgactccgagatggaagccatccgcaccaagaagggcaagcgcaacaagcccgtccgtggtggtcgcgtagagtggaccccaatctgcaccggcaacgctgcctactaattcccaaccttaggagatcccaatgcaagttatcgttaccgccacttcgtccaaagttgacgacctgatcctgatcgaaacctcaaccaccatcggtgacgttacgaccaccgccaagactggctatgacgttcaagagctgatggacaaccgctttctcagtggcgaccttgagactcgcatcgaagcccttcgggtcggtgccgaggctgtgaccatccgctccgttgaggcgcactttaagaccctgatgaacatccttaagaagcccgctgaggtgactgacgtgagcgcggtcccttcgagccaactgcaaggcgtcaaggctgacgtgatgatcgtcgatgaggcccaggctgaacctgtgactgagccggtgaagaaaacccgcgctcctcgcaagcctaaaaccaccactaccgaatccaactaaggggaaccccatgtccaaagtcgaagccgttatcctgaacaccaagccattccgcccaaccgactacaacgagaaggctgtcgaggctgttctggatgagtcctacctgatcgctgatgtcaagaaggacggcgttcgtttgaacctgtgcgtgaacctgatcgagaccaagcatgaccacggttgggaagtcgagtggttgtcccgtgagggtaagcgcttcccggccttcgggccatctcatggtcctctggacaccgaccctcgctgggctgacttcttcaacgagaacaaaggcgaggggatgttccctcaagggttcatgttggacgctgagctggtcctgaccgacatggatgaccgtgaggttccctgcaagaccacctcgggcaccctgcgccgtaaagaggagtcgatcccgctgagccgcatccgggtctacgtcttcgacatcgtaccaatggacgttgtgctgagcggtgaggaatacgaggtcttccagtgcgtccgtaagatccacgttgagtatcaggtagccaagctcaaggaatacttcccagagatccaatggatcgccgctgagtcctacgaggtcttctcagtggagaccatgccagtggttgagcgtgaaggcttcgacgaggagggcaacgagatcaccgtaaagctccaaccgccactctcgctggtccagctctacacctcggtgcgtgagcgtaaggaggagggtttggtggtcaaagatccgatgggcttctatcgccgctcgaagtgcaacggctggtggaagaaggtgccgagcaacaacgaggacggcaaggtggttggtctggtctggggctcgaagggtaaagccaacgagggaaaggtgatcggcttcgaggttcaacttgagtccggccatgtggtcaacgcttgcaagatcagtaaggcccagatggaggagttcaccaagaaagtgatggaccacaacggttatgacgttgaggacatcgagtcgatcatctacgggatgggcagctcattggttgactctgagaacccgtaccaccaccacatggtccgagtcacctgcatggaacgctaccctgatgggtcgatgcgtcacccgagcttcgacgagttccgtggtatcagcgatccactcatcaaagagtaactaaacgagcctcatcgacttcggtcggtggggcttttttgtgcctgtctgaataggagaaatctatgatcaagttcctcatgatagttttcgttgtgatcaccttcgccatccttatagctggcttcgagcctgaccggactcccgtggagcgcctctacgacgaggattaataaaccctcactgttgcgagacacccaaccaaccaccaaaaggagatccaaacgatgcccgttaaagaccgttcgttcgcctaccgtctgcaccaatcgaacatcgaccgtcaacgcaactgcgcccggttcaacatccgtccacctaaaccaccagcgccaaaggccgacttctggcagcgcaccaagacgttcttcaagaacctctggaccaagatcaaggagatcgtcaatgactgacatcatcgccctgacttctgagcgtggtcgtagcggcaaagacaccctgtgcgagcttctgatgatcgagggctaccgggtctaccgggtcgcctttggggatgtcctcaagaagcaatgcagccacatgctggccctcgacgaatgccaacgcatcgttatggagagccacatgcacaccgacttcaaggacgctcagttcgaggagttggcaattgaggcgatccctgagagcgagtacaaggattggctgctgaatgagccccagatcctcgacattgagatcccaaggacacctcgctggcacctccagcaatacggcaccggcttccgtcgcaactacaagcagaacccggacgtgtggctgctggagggtctcaaggagatcaagaaggctcccaaggatgccctcgtggtcgtcactgacatgcgtcaagccaacgaatatgcagcactgagcatccgccaagcgcacctcgttcgtctctcccgagactgggcgatccctgctgtggatgaccagccgctccacgctactgacattgaactgcgtgacttccaaatggacgccgttgtggtgaacaagtggggccacgcctcggagatgatcgaccaactcagaactcaaggagtaattactcatgcctaagcaagaccagaaaatgaagaagttcctcgtcaccgtggagtaccgcaaggaggtccaagaggtgccaatgtatggccgcaccattgaggaagcgctcgaagctgctgaccttgagtacggtgaagacaacgttcggcgcattcgcccggaggtcactcaatgaacctggcccaaggcaacacccgctcgatgcctgatggcttcctccacatccagaacttcaccgtgaccaagcacgcggggatggctggcgtggtctacatccacatccttgacgcccatcaacgtcagttggtcgaagggctgctcattgagcgcgccatcgtgaccgctgagctggaaggcaaggagctgcaccacttcaaacacggctgctggcggttctccaaggagttcctcaagaacaacttccgtgaggtcgtccatgcgatgaccaaggtgacgctgatcccggtcattgagaccttcaagcagaccctgttcaccgagcgtgaatccctctcgtactgaataaaccctcactgttgcgagacacctaccttcccactttcataggagataatcccg

SEQ ID NO: 6 - DNA, 41379 bp, unidentified
  misc_feature 1..11: note = bacteriophages nucleic acid sequence
  source 1..41379: mol_type = genomic DNA
tcactaccaagttcatcgcttgttcatcgtgtacaacggtgagcatatcaccatcaccatcgaaggtgtctgagcgattcgctgtagggccttccttgagggctctatgggaacaactcaacgtcacaccaacaacctgggagcaatcaccatggcactgactcaactcaaaactgacaccaccgagatcgctggcaagacctacctgacccgtcattggtacatggatggtcgcaaggttccgggctctgagcatcacgagatggacggctccgctgctcatcgcacctactacgctcagttcgtaacaccggctgttctccgggtcgtcaaggcccactttagcaagtcgcaatgggcactcatgggcaatgcctacctcaacggtggtgaccattacctcaatgagtcctcaaggctgcaccagtgggaccaatgcgacatcaagcagatggttggtcgcaccgtcaccgagtgtgcctacagcgatgtccctaagggcaccatgtattggtcaccgagtgagaacacctgcatcaccaaggaagccgctcggatgctcattgagtccggggagtacctgcaatgagcgttcctaccttccgccagatgctctaccgggtgatcattgaggaactcaagaaggagggcatcaagttcgggcaagatcctcacacgctctcctccagtcaatccaacacgctctatgagtgggctcaagcgatgcgctacaagccatccgctacagcctcgctgtcaccgggtcgtcagttctacgtcttcctctcccgtctggagcaagtgcaatgaaaatgaccaacgagcaaatcaaggccaagtatccggccaccgctgagcgcatcattggggaacgccgagtcctccgtaagctgctcactgcgatcactggctctggctactgcttccgcatcaacaacggcgaggacttcgagaccaaccacacctacaccgtgcaagttggcattgacgcctgcatggctactgatgaggaccatgtggtggtctaccgggttcgccctgatgacggcacctaccaacgcatcggcaagttctggctggtctatgggaactccgctgaggaggtcatagccgactacagcgccatcacatcgttcgagtccatgttctccagatggttcgacgaagccaccatagacgccgagtgattcactgatgggccttcgctgagggctcattgggaacaactcaacgcaaaccacataggagatccaaatgatccacgcaatcgctcgccagtccaaaaacatctgcctgttcgctctgttcgctaccgtgatcgccctcggggccatccatgcgaatgacgctgaggcacgaggtttctcgggtagtcggtcgagtagctccagctcatcccgctcttacagcgcaccgcgtaccagctcctacaagcctgcccctcgggtcgtccagaacgtcaccgtcaaccgtaccactgtggtccatcaatcggctccagcggccatgggcggtggctctggtggcttcatgagtaccgtagcgggctcctttgcgggcacctctctggcgaactggtggaacaactccagcaacgaggagaaggccgaaaagcaacgccttgaagacgagcagaagcaacgcgatgaggccgctgcactggaacgcctcaagctggacctgctgattcagcaacaatcgggcaagccaatcgaaggcatgttgccaccgggcaaataagcacctctctacgatggtcaataagagcctgccttcgcgtcgataacagcgcaaaggtgggcattctgtaccgctccatttaccgcacgtcttaggtctttgaattatgcaacgctacaaccgtactaacttcacctcggctgcatttgctgaacgtctcatcgctgctatgcgtggcgctctctctgatggttacgcccactatgtggagaaccggcacgggcaacgctggctccgtgtggacgtaaaacccgacgacttcgggggctacaccttccagttccttgctggttctggtcaagacgttggcagcctgatcttgcaagcctgcttcgtctggtccgaggagcatgagcgagccttctcggggttgttgagcgaattatacacacgttccgaacatcctttgttgaccgctcgtcgtcgtgatgcagaactggaagctgaaagcaagcccaaacctgcaaaaaatcgttggaaatcagcacttaaagagacccttgggtacttgactgcgcttgcggttggtggtggtgctgggcatggactcgtcgcactgggagtgttcggatgagtaccgttctcactaaggccaccacgggtatcgcatcggttgacaagtaccatccccttctgcgtgagcatcttgagaccctcaaggagatggccgcatacgctgaggacaacggcgggatcaacccgagcaagttctctgagtcctcctcgtggcaaaagttccttgacgattgcgtggtctgccatgcaccgggggtctactcggtcgcctacctgcatccgggctactgccgcgacatcaagcacgagatgagcaagttcgtcttcgagcccaaccttgaggagccccttgaggcgcagatccctgaggtgaccttgcaggatgaacacaaggtgctgttcgaggtcttccggtccttctgggctgacgctgggatcgcctacgccaaggtgctgttcaaccttgagcctgagaacctgaccagtgtacaggctgcccgctatgagccctcagagactccacgaggccactggcacaccgaccgggactctgacgtcactctggtggtggcgctcaacgatgaccatgtagggggcggcacgatggctgctcaagggcctttcttccctgacgtgatggtccctcagaacgaacccggctggggcatgttcttcaagggtaaaacgaccctgcactacggcctgcctgtcaccgaaggctgccgacaactactggtccactggagtgaagttaagtgatgcacacgaattaccagcctcgaaagccggggctcattgaccaacgaatcatcacctcaaagaacaccgttcgcaccgggaaggacgcctttggctactggtacggacgccgcaaggacttcactgaggcgttcctgagtgccatggaagctcgccaagtggtgggcggtatgttgtgccccggcctgcgctacagcgaccgtggggacttcactcgctgctatcggggagggttctgagatgcgtggcttctctaagcgcccctcaatgattccttcgccacccagcgactacacccagcgcgccaagctcatcaagttccgcgcctcgtgggtcgatccgaacacctacgggctcgtcaaggctaaagagctgacctttgagctgggccttgggccttgtggtcgtcacgttgtcagcctgggagttgccatcactgatgacctactgacgatcaagcagtggtcacgaagccctgagctgctcaatgagcctcaatgcgatgccaagtggaagctggagcggcaccagcgcttagagcgcacctaccggcctgctgtgaccctcaagcggcaagagctgcgagtcaccgggatgctctggtggcgcaaagaggaatgggtcgatgtcattgagaccacccatggtgatgcggtcaagcctgagggtctccttgaggactccgaagtggccgaactgcgagaccagatcagcaagtattactccgctatcacgaagtggaacgatgacctcgaactcaagacatttgtctacaagatggccgacgttcatggccggatcgaggtggttaagtaaggctggattaataaaccctcactgttgcgagacacctcagagggttcctgcctaaaagatcaccttaaagacatcttaaagatccctctgagataaaccttatagagcaattctataagacaactatatctcatagagcatcttaaagaatgatccccgagcgtcacgacttcgctgacatcgcaacatcctcattcgccttcaatcaactctccagcatctacggccccgaactggccgctgagcaactgcgcttggaacacgaagcgtacacgcttggagaggaacgctttcatcgccagatggagcgccagatggagcgcggtgagttctccaacaacatcgccgctcagccgctgctgggcactctggtccctaagatgtccgctgcgatcaccgcatggatcgaccaccaagccaacaagggtcgtggccgtaaacatgtgagcttcgccgctgcacagcaaatgaacccggacacgatggccgctgtgaccatccgctacgttctcaacatgatcgcccagcgccgtaatggtgccccaacggtgaccgagatgagcatcgtggtcggtggagccctcgaagacgaagcgcgctttggccgcatccgagtccttgaggccgaacacttcaagcgagccatcgccccggctctcgccaagcgcaacggtatgacctacaagaaggcgtacatggagcgggtcgaggagtcgatgctacagaagggcgaactggcccaaccatgggttgactggaacgtcgctgactcagatgtccgcttccacatgggcatccgaatgctggagctgttgatcgaatcgacccaactgatcgaggttcgccgtgatcacgctggggacaagaagaacgatggcgagtatgtgttcctcaaggatgaatgggctgacaagatccagaaccgggccttcgcactggccggtatcacgcctcagtaccaaccctgcatcgttccgcctaaaccgtggaagggtctgcaaggtggcggttactgggccaagggtcgcaagcctctgaccttcatccgactcaacggcaagcaagcccgagagcgctaccgggatgtcgagatgcctgcggtttaccgggcagtcaacatcgcacagtcaaccgcttgggcagtcaataagcgcgtccttgaggttgccaatgcggtgatggaatggaagaacgtacagatcaaggagttccctacaacggaacgccaagagctgccactgaaaccccacgacatcgacaccaacccagacgctctcaaggcgtggaagaaggaggccgctggggtctaccgtaaggacgccgcaagggtatcccggcgattggcctacgagttcggactggagcaagccaacaagtttgctgagtacgatgcgatctacttcccgtacaacctcgattggcgtggccgggtctacgcggtccctgccttcaaccctcagtctaacgacatgaccaaagggatcttgcaggctgcccatggggaacctgtaggcgaggagggaatcgagtggctcatgattcacggggccaacactgcgggcgtcgataaggtgccctttcctgaacgtaaacaatgggtccgagaccatgaagaactcatcttggcgattgccaacgatcccctcaacgtcaccgaatggatgtccatggactccccgttctgcttcctcgctttctgctttgaatgggctggcgttaaagctaatggcgctgcacacgtcagtgccctaccccttgcgttcgatggttcctgttctggcatccagcacttttccgcgatgcttcgagatgaacgtggtgggcgtgctgtcaacctcatcccttcggactccgttcaagacatctacaagatcgtctctgatgaagtcgagatcgctctgcaatatgacctcaagtacgggacggacgactggatcgaaactctcgtcgatgaggtcactggagagatccgcgatgttaaacgtctcggcactaagaccctcgccattgcgtggctcacttacgggatgtctcgtaaggtcaccaagcggtctgtaatgacgctggcctacgggtcgaaagcctacgggttcgctgatcaagtccgagaggacatcgtaaagaaggccatcgacaacgatgagggccacatgttcacaagccccggtgaagcgagccgttacatggctggcaaaatctgggactcggtgagtgttgttgtggtcgccgctgtggaagcaatgaactggctacagaaggccgccaagctgctggcctctgaggtcaagtgcaagaagaccaaagagatcctcaagcctgccatgcccgtctactggacgacccctgatgggttcccggtatggcagcaatacacgatcaacccaacgcgccgaatcgacctcatgttcctcggggacgttcgcatccaagccaccgtgatgatgcgcgacaacgggtccagcaagatcaacgcaaggaagcaagagtcgggtatctctccgaactttgttcacagccaagacggctcgcaccttcgcaagacagtcgtacacggttacgacaaccacgggattcgattcttcgccctgatccacgactcgttcggcaccatccctgccaaagctggcgcgatgttccgggcagtccgcgagaccatggtcgaaacctacgagaacaacaacgtgctggctgacttccgtgagcaattcatggagcaactacacgagagccaactggacaagatgcctgagcttccaaagatgggaacgctcaacatccgcgacatcctcaaatccgacttcgccttcgcataaggaaaccaattatgaacgccgctcagaacttcgttaagaccaccaaacgtaccatgcgtgatgactccgagatggaagccatccgcaccaagaagggcaagcgcaacaagcccgtccgtggtggtcgcgtagagtggaccccaatctgcaccggcaacgctgcctactaattcccaaccttaggagatcccaatgcaagttatcgttaccgccacttcgtccaaagttgacgacctgatcctgatcgaaacctccaccaccatcggtgacgttacgaccaccgccaagactggctatgacgttcaagagctgatggacaaccgctttctcagtggtgaccttgagactcgcatcgaagcccttcgggtcggtgccgaggctgtgaccatccgctccgttgaggcgcactttaagaccctgatgaacatccttaagaagcccgctgaggtgactgacgtgagcgcggtcccttcgagccaactgcaaggcgtcaaggctgacgtgatgatcgtcgatgaggcccaggctgaacctgtgactgagccggtgaagaaaacccgcgctcctcgtaagcctaaaaccaccaccaccgaatccaactaaggggaaccccatgtccaaagtcgaagccgttatcctgaacaccaagccattccgcccaaccgactacaacgagaaggctgttgaggctgttctggatgagtcctacctgatcgctgatgtcaagaaggacggcgttcgtttgaacctgtgcgtgaacctgatcgagaccaagcatgaccacggttgggaagtcgagtggttgtcccgtgagggcaagcgcttcccggccttcgggccatctcatggtcctctggacaccgaccctcgctgggctgacttcttcaacgcgaacaaaggcgaggggatgttccctcaagggttcatgttggacgctgagctggtcctgaccgacatggatgaccgtgaggttccctgtaagaccacctcgggcaccctgcgccgtaaagaggagtcgatcccactgagccgcatccgggtctacgtcttcgacatcgtaccaatggacgttgtgctgagcggtgaggaatacgaggtcttccagtgcgtccgtaagatccacgttgagtatcaggtagccaagctcaaggaatacttcccagagatccaatggatcgtcgctgagtcctacgaggtcttctcagtggagaccatgccagtggttgagcgtgaaggcttcgacgaggagggcaacgagatcaccgtcaaactccaaccgccactctcgctggtccagctctacacctcggtgcgtgagcgcaaggaggagggtctggtggtcaaagatccgatgggcttctatcgccgctcgaagtgcaacggctggtggaagaaggtgccgagcaacaacgaggacggcaaggtggttggtctggtctggggctcgaagggtaaagccaacgagggcaaggtgatcggcttcgaggttcaacttgagtccggccatgtggtcaacgcttgcaagatcagtaaggcccagatggaggagttcaccaagaaagtgatggaccacaacggttatgacgttgaggacatcgagtcgatcatctacgggatgggcagctcattggttgacgctgagaacccgtaccaccaccacatggtccgagtgacctgcatggaacgctaccctgatgggtcgatgcgtcacccgagcttcgacgagttccgtggtatcagcgatccactcatcaaagagtaactaaacgagcctcatcgacttcggtcggtggggcttttttgtgcctgtctgaataggagaaatctatgatcaagttcctcatgatagttttcgttgtgatcaccttcgccatccttatagctggcttcgagcctgaccggactcccgtggagcgcctctacgacgacgaggattaataaaccctcactgttgcgagacacccaaccaaccaccgaaaggagatccaaacgatgcccgttaaagaccgttcgttcgcctaccgtctgcaccaatcgaacatcgaccgtcaacgcaactgcgcccggttcaacatccgtccacctaaaccaccagcgccaaaggccgacttctggcagcgcaccaagacgttcttcaagaacctctggaccaagatcaaggagatcgtcaatgactgacatcatcgccctgacttctgagcgtggtcgtagcggcaaagacaccctgtgcgagcttctgatgatcgagggctaccgggtctaccgggtcgcctttggggatgtcctcaagaagcaatgcagccacatgctggccctcgacgaatgccaacgcatcgttatggagagccacatgcacaccgacttcaaggacgctcagttcgaggagttggcaatcgaggcgatccctgagagcgagtacaaggactggctgctgaatgagccccagatcctcgacattgagatcccaaggacacctcgctggcacctccagcaatacggcaccggcttccgtcgcaactacaagcagaacccggacgtgtggctgctggagggtctcaaggagatcaagaaggctcccaaggatgccctcgtggtcgtcactgacatgcgtcaagccaacgaatatgcagcactgagcatccgccaagcgcacctcgttcgtctctcccgagactgggcgatccctgctgtggatgaccagccgctccacgctactgacattgaactgcgtgacttccaaatggacgccgttgtggtgaacaagtggggccacgcctcggagatgatcgaccaactcagaactcaaggagtaattactcatgcctaagcaagaccagaaaatgaagaagttcctcgtcaccgtggagtaccgcaaggaggtccaagaggtgccaatgtatggccgcaccattgaggaagcgctcgaagctgctgaccttgagtacggtgaagacaacgttcggcgcatccgcccggaggtcactcaatgaacctggcccaaggcaacacccgctcgatgcctgacggcttcctccacatccagaacttcaccgtgaccaagcacgcggggatggctggcgtggtctacatccacatccttgacgcccatcaacgtcagttggtcgaagggctgctcattgagcgcgccatcgttaccgctgagctggaaggcaaggagctgcaccacttcaaacacggctgctggcggttctccaaggagttcctcaagaacaacttccgtgaggtcgtccatgcgatgaccaaggtgacgctgatcccggtcattgagaccttcaagcagaccctgttcaccgagcgtgaatccctctcgtactgaataaaccctcactgttgcgagacacctaccttcccactttcataggagataatcccgatggcaaaatccaccaagcagttcttctttactccgaaaggcgtagctgaaccttactgctcgatccaaaagccggactacggcaacccagagaaaggcttcggcaaccctcgtggcgtctataaggtcaacctgaccgtgagccgtgctgatgcccagccaatcatcgaccgcatcgttcgtatgcaggaacaaagctacgcggcaatctgcgaggacttcgagaagaaccgcgcatcgctgaccgccaagctggcccgtggtaagaaactgctggaaccctatgagggcgacctgccgttcttcgagaacgacgatggcaccgtgacgttcaagttctccagctacgcctcgtaccaagacaaggaaaccaaagagaccaagccgctgaccttgaaggtcgtggacgccaagggcaagcgcatcgacgctgttcctgcgatctctggtggttccgagttgaaggttcgcttctccatgttcgcctacaccttcggtgccgttgtcggtgcctcggtcaagctgcaactggatagcgtgatgctgatcaaactggtcgagtacgctgctggcaatgacgactgggctgacgaaaccgaagaaggctacgtcgctccagagcgtgaagaaagctgggacgatcacgaagaccaaggccacgctggcgaggttattcctgacgctgcctcggacttctgatggctggctacgctggcccgaagggcgctcgtacaggcgcttttcgatccggccttgaagaccgcaacgcggctcacatggacaagctcggagtccctttcgacttcgagcagtaccacattaagtacgtcgttccggcccgtgaggccaagtacacacctgacttcgttctgcgtaacgggatcatcgtggagaccaaagggatatgggaagtggacgaccggaaaaagcatctgctgatccgtgagcaataccctgaccttgacatccgtctggtcttctcgaactccaagagcaagatctataagggctccccaacgagctacgccgacttctgcacgaagcacgggatcatgttcgcagacaaactcattcctaaagcatggctacaggagaaacgtaaggagatcccagcggggatactccatccgaaaggaggtaaatgatgccaaaggctgctttcaagaaacgcccaagtacgaccctgctcgtggtccattgcgcggcaaccaaaccgaccatggacatcggcgttcgagagatccgccagtggcatgttcaacaaggctggctggacgttggctatcacttcgtcattcgccgtaacggcactgtcgaggatggtcgccctcatgacgtcattgggtcacacgccaagggctacaactccacctcgctgggcatctgcctcgttggtgggatcaacgccaagggcgccccagagaacaacttcacgcctgagcaattcaactcgctcaagctgctgctgatcgctcacaagcgcacctatccgcaagccaagatcgtgggtcaccgcgacctcgactcgggtaaagcctgcccgtccttcgacgtggccgagtggctgaaaactcaagggatttaataaaccctcactgttgcgacacggcctcactgacttcggttggtggggctttgttgtttttaaacgttgactttaggaggtcattatgaatcgttccttactgcaaggtgggttcgacctttgtgagcatctcattgaccgtggcatcggcgcgattatcgctggtggctgtgcccgtgacctgttcttctcggttgagcctaaagacatcgacatcatttgcgcgggcaccgacccggagactgtttccagagcgctcgatgaaggtggctacacctaccacaagttccccaagtaccacaccggctccgactctgatcggctgcaaggtgtctggaaaatcgaaggctgcgagatcgacgtgattctttacgaggtcgagtgtgtcaccgaggccatccagaagttcgactacaacctcaatcagttcgccatctcgggcatccaaaggggcatcgaaggggcaaccattcgcttcatgggcgctcacgcttggaccaatctggttcaactgcgagaggacgctcgtggctcccgtgctgaaaagatggaagccaagtggctggacctgattcacaaggcaccgatgcgtgatggtcggtacgtcgatgagatcgaggtggccgatgtcgtcgcatgaggaacgcgaagaaagcgttttccttgcgcatatcccgtgtgaggaatgtgggtcgtcggatgcaaactcgctgttctctgatggtcaccaatactgctttgcgtgtccccctgagactgcctacaaggcacccgatgggaaggagcgtggggagttcacaccgaggctcaaagctgacggcacgctctcgatgggcgaggctggaggctacttctcggcgctccctaagaggttcctacaggagccaatctgccgcctctatggttactggatcggcaaggcgttctcgcctcatgagggcaaggaagtcccggtacagatagccaactactacgacaccgagggcaacctcaagtcgcagaagtgccgtcaagccaacaaggacttcttcaccaagggcaagcacgacaaggacgctctgttcggtcggcacctgtggaacggtggtcgcaagatcgtcgtcaccgagggtgagatcgactgcctgacagtggcccagatccaaggtggtaagtatccggtcgtgtccattgggcatggctcgaaggctgccaaggcgacctgtgcggccaactacgcctacttcgatcagttcgacgagatcatcctaatgttcgacatggatgagcccggacggattgcctcaagggaagccgctgaggttctcccaccgggcaaggtcaagatcgcagtcctgcctttcaaagacccgaacgagtgcctccagaactcccaggccaaagctgtgatggacgccatgtggaacgctgccccattcgtaccggatggagtggtctctgcgaagtccctcaaggcccgcatcaaggagaagaaagcggtcccgagttatccactcgtggctccttacgaactccgcaagatgaccaaggacatccgcgaaggtgaggtcgttctggtcacctctgggtccggctcaggcaagtccaccttcgttcgccagaacacttacaacctgttcaatgactgcgggattcccgtaggcgtggcgatgctggaggaggccgttgaggaaaccgtacaggacatcgtagggctccacatgggatcacgagttcgtcagaaccccgatgagaccaccgaggagatgttcgacaaggcgttcgacgagatcttcgagagcgacaagctgcacctctatgacgccttcgctgagtccgctgaggatcgcctattggcgcgactggcgtacatggtcgaagtcaacggctgcaaggtgatcgtacttgaccacatctcaatcgtggtctctgcgatggacggtgagaacgatgaacgcaagatgatcgaccggctcatgaccaagctcaagagcttcgccaagaccaagaacgttgtcgtcttcgttatctgccacttgaagaacccggacaaaggcaaacctcacgaggaaggacgacctgtcaccgctaccgacctgcgagggtccggtggtctgcgtcaactgagcgacaccatcatcgctgtagagcgaaaccaacaaggtgccaaccctaacctcatcctgttccgactcctcaagtgtcgattcacgggcgagacgggcgtggctggctacatggaatacgacaagcggactggtcgattggtagcgaagcctgagggctggcgacctgaccaagatgcaactgacgccgctgatgctgcatgggcagaccagcaagaacctgacttttaaaggagaaccaaaccatgaagaacttcgacctcgtaactttcctgatcactctggctggccgcattcaagagaagcgtcacgctcgtttggtggctcgtgaagcgtccttgaaggctgccatcacggctgctcaaaacgccctgcaaaccaccgtcgatcaacgtgtgcaagccaaatggaaacacgaagacatcaagcgcgtgagctgatccaagggcctctctttgaggggccttttagtgagttcacacatcaatgctacaggggggaatacacatgaatggttctgacgttcgcaagttcatcaaacgtggtgagcaggccgctgaggtactcgaaaagctgggctactcgtacatcgagaaggctgggcatcacccacattgggaagccccagtaaacccgatggacccaatccttgaggcgctcaacaagatgatcgctgagaaggttgacgctgacatcaaggcccgcattaaggacgacccaaggggtccgaactggcacctcgttgcaccaatggtcggcaaggacttccgtgttcaatgcgccaagatcccggccaatagccaactggcgtcattcgcctttggtcctcacttcgctggcaaggtgttccgcgccatcgagatccgctatcaccgctccgaggagtacaccggctatgccgtgctgttccacttcaacgtgcgcccgtatcgcccagaagtcgtatggctgcctttgagcgctgtcgccttctccaactaaggagggcctcatgctcatctctgacatcgaaacgaacgggctctatgagtccgtcactcggttccactgcgccaccattcaggactatttcaccgggcaatatgttcggtacaacgagtccaccttcaaggagtacatcgctgcccttgaggccgaagctgccaagcctgacggtatgatcgttgggcacaacttcatcaagtacgacatcccggtcctcgacaagctcaagcgtctctacttcggtaagcgtttgaacatcccaaggaagcgcgtgatggacaccctcgtgatgacccgtctggtttactccaacgttggtgatcgtgactcgggtctcatgcgttcgggcatcctccccggcaagatgtttggctctcactcccttgaggcgtggggctatcgtctgggcgagatgaagggtgaatacaagcacgacttcaaggtccagcttgagaacgatggtggcgtctacgttgacggtatggagtggctggaatgctccgagtccatggaggactactgtgagcaggacgttcgggtcacctcgaagttgttccgcaagatcatctccgacctgcactacttcaacgatcaaggcgaggccattgaggccatccgattggaacatgcggctgcgtggtcgctggcccagatggaacgcaatggcttccccttcgacatcgagggagctgagaagctctattgtgagctggctggtcgtcgtagcgatctcctcgtggaactcatccagaccttcgggtcgtggtggtctccgaaaggtggtaagtcgcagttcctcaacccgaagactggtgcaccaatcgactactggtctgatggccgtgtcatgccgaaggtggtctatcccaagatcggtggcgtgttcctcaagagcggcaagaaggacacccgagagaccttcgagggctgcccttacacgccaatcgaactggtcacgttcaaccccggatctcgggcgcaccttgagaaagtcctccgtgatgctggctgggttccgaccgagctgaccaacacgggcgctgccaagatggacgatgagacccttgagttcgtccgtgtggctgaccctaagaagcaagcgtgcatcaaccttgtgcgtgagttcatggaggtcaccaaggtcattgggatgctctctgagggcgacaaagcatggctgcgatacgtccgtgaggatggctgcattcatggctcagtgaaccccaatggggctgtaacaggccgtgcgacccatagccacccaaacatgggccaagtgcccagcgctaagaagaagtacggacctgcgtgccgtgcgctctttggggcggtctttgcgaggaagctcaagaagggctgggagaacgccgtccagttagggactgacgcctctggccttgagctgcgctgtctgggtcacttcggtgcgccattcgacgaaggctcgtatgccgagaccgtgttgaacggtgacatccactgggtaaatgcgctcgctgctggcatcgctcctcctggcctaatccgtgacaaagagaaccatgaacatgacgcctaccgggacaccgcgaagacgttcatctatgcgttcctctatggcgctggtgatggtctcgttgggtcgttcgttggtggtggcaagaaggaaggtaaggcactcaagaaggcgttcatggagaacaccccggccatctctggcctgaggggagcccttgaggagcaactgatctccgagcagaagtacaacaacgtcaccaagaagtacgacatcaagtggaagcgccgttggatcaaaggtctcgatggccgaaagatccatgtccgctcccctcactctgcgctcaactcgctgctccagtccgctggcgcgcttgtgtgcaagaagtgggtcgtcgaggtggaacgcattctcgtcgaggagcatggccttgttcatggctggtacgacgacgatggcaaccccggtgacttctgcttcatggcgtgggttcacgacgaactccagattgcctgtcgcaaccaagaaatcgctgagctggtcgcaaaggtctccaacgaggccatccgactggtaggcgaatcattcaaattccgctgcccactggctaccgattccaagatcggcccaacgtggcgcgagtgtcactaaggagatccttatgagcatgactctgaaactgaacgtgtccttcccgatgaccatcgtggtaaagaccgagaccctgaaagccttcgacgaaacccgtgaggaggcccgcaagatccccgctgaggagatcgccaagctcaagggtgagaccaagttccgcgctgagctgttccgtggcgaccgtaccactgagcaagtgatggagctgatctaccgtgctggcatccgtgagctgatccgtaaggaactggtcgaggagatcaccggcaacgaatcgaccgcccgactgggctgcatcaaggtgacctatgaggccccacctaagcgttcctgtcagggctgcattgagaccaactgcgtgatggccgagcggaacactaacgctggctgcgacaacaagcgcactggtgtccgtgagcccggtccccgttggactgagacggtatgaatgagtacctaaaggttctctgggaaatcaaaaagcaagcgaggtcgtatcaaagcgacttcgttcgttcccgcattgcgctggtcaacgaggcttcatcccgaggccacatctcgtgcctatcaactgccggtaagaacatgggtctctggaccttgaccacttccggccaagacttcctcgcacaatatggaggtgccgtttgagtaaactgaaagtgggcctcgcccatgatatggactacctcatcttctcagcgatgtccgctgctgaggaggagcaggactggggcgaagacgtatggaccctgttctgcgatcacaagaaagcccgtgacattctgttcggcaccatcaagaccatcaaggcgaacatcgccgcacaactcaagcgcaagttcaagctcactgaggacaagtacgagttcgtggacatctgcatcctgagcggtgacgacaactggcgtaaggatgtccttgagacctataaggccaaccgtaagggcaagcgtaagcctgtgggctaccgcaagttctgcgatgagatcatggcgcactacggtgaaatgtccctcaagtggcatggtgtcgaaggtgacgatgtttgtggcgtcctgatgactgacccgagcatcgttaagtgtgaccgtgtgatcggcgtgagctgtgacaaggacttcaacacggtgccgggatacttcttctggctgaccgagcaggaactcatcaagaacgatgaggcaacctcggacctgcaccacttctatcagaccctcaagggcgacaccacggatggctatggtggcgtaccgggagtcggtggtgagttcgatggtggcctgatggattggctccagtctccgaagttctacttccaagacgtgaaggtcatgaagtccggcaaacgtaaaggcgaggaggttccgttctggacttcccgtgagcccgatggcgagtccctctgggactgcatggtgtcgctcgctgccaagcagggaatgactgaggaggagttggtggtccaagcccaagtggctcgcatctgccgcgcttcggacttcgatatggagaccatgaagccaatcctctggcgtccctaatttaccctcactattgcgagagggagcccagtgttcccttaaggagtcctattgctcaagcagatccaacactacatccaaaacccggatgacatccctgacatctctcccgcatctgccgactatctcaacgtccgtctcaacgcttcctatctgatctccactggtgctgtcgatgatctccgcaaagcggggttctccgagcagtacatcatgggcttcattgacggatgccatggggcgactgagatagtggagctgatgcaggaggctcaactaaacaaggaggaatgaccatgtgtttcaagtccaaggtcaagaccccaaagaccaaccctgatgctgtgaaagcgcctgagccggttctcattgaggaacctaaaggcgtggacttcggctcaaccgaggacgatgacacctccagcgatgagggtctcgatggtctcaaggtcaagaagtccgatgtttccacaaaggacactggcgatggttcgtctgatgctgtcgctgctgatacaggcaccgggaccatcaagaagtccaagcctgctgcatccatcaagaaggctctcaagaaggtcactaagtgaacctggctgcgcatgtccagaaggaaggtcacccggcctgcttccgtgaggtgctgagcgacatccttgaggaactcactgagctgacgtggggcgggtccagagtcgaatgctacgagcgcatctgccggtcaaccgaagaacttgacgaacgcatagagatcaccgtgagagaccctcaagggaagctcgtggggttcgctgtggtcgtcaatgatgaggatgaccatgtaggtgagtgtctcggaacgcaatggcactgggttcacccggaccaccgtggccccgtgggtcgaatgatccttcgggcaatcgttaggctggcctccaatgctggctacaagaccgtggcgtacacgaagcgcttaggcgtgggtcgctacgagatcaattacaaacaactgaaggagaacatccatgggcaagaaaattaagaaggtcgtcaagaaggtcaccaaggctgtcgttaaagtcgctgacccggctggcgtgatcaaggaagcaactggcggtaacgatgcgcctgctcaggtagtcgaggcacctgccgcaccgacccctgtggctgcccctgcgcctgtctcagcggctgtcgttgaggccccgaaggataccactgagggctccgatgatgctgacaccgaggctgccaagaaggctgcccgtgcgcgtggtaaacgtggtctgagcgtggctcgttccgctggtactggcatcaacatctaaccaaggaggtgacccgtggcgactacaactcgcaccgggctcgctgaggagggcgcaaaggctgtttacgaacggctgaaaaacgaccgagttccctacgagacccgtgctgaaaactgcgcgaaggtcaccatcccctcgctgttccctaaagactccgacaacgcctctactgactactccactccgtggcaagcagtgggcgctcgtgggctcaacaacctgtctgccaaggtcatgctggctctattcccgctgcaaagctggatgaagctcaaggtgtccgagtggcaagcgaagcaactggtctccgacccttcgcaactggctgtcgtggaacaaggcttgggcatggttgagcgaatcctgatgtcctacatggaagccaactcgtaccgtgtgacgctctttgagctgatccgtcagttggcccttgcagggtccgctctgatctacctgccaccaccagacgcatcgtcgtctgcgtacaacccgatgaagctctacacgctccacaaccatgtggtccaacgtgatgccttcgggaacgtcttacagatcgtcaccgtggataaggtcgcctttgcggctctccctgaggacgttcgcaactctcttggcgctgatggcgagcgcaagcccgaccaagagatcgaggtctacacccatgtttatctggacgatgagtctggtgagttcgcttcttatcaggaagtggatggtgtcgaagtcgatgggtccgaaggtcagtatcctctggatgcctgcccgtggatcgctgtgcgctggaccaaacgtgatggcgagcattatggccgctctcatgtcgaggaatacctcggtgacctgaactcccttgagtctctccatgaggccatgatcaagttctcgatggtcgcctcgaaggtgatcggactggtgaaccctaacggtgtcactcaggttcgtcgtttggtgaaggctcagactggtgactttgttgccggtaagaagtccgacatcgagttcctccagttggagaagaccgctgacttcacagtcgctaagtctgtcgctgatgccattgagcaacgcctctcctacgtcttcatgttgaactctgcggtacaacgcaagggcgaacgtgtgactgccgaggagatccgctatgtggcgagtgaacttgaggacacccttgggggcgtctattcgattctctctcaggaactccaactcccaatcgtccgcatcctgttgaaccaactacaggcaacctcgcagatcccagacatgccgaaggaggccgttgagccgactgtcagcactggtgtcgaggcactgggtcgtggtcaggacttggacaagctcaatcagttcttgagcgcaatggctaacgtgagtcagctacaggctgatccagacctcaacatgagcaacatcaagttgagactggcgaacgctataggcatcgacacgtccggtctgctgctcactgaggccgagaaggctcagctccaatcccaagagatgctcaagcaaggtggcctcaacgctgctgctggcatcggtcagggtctcgctcaacaagcgaccgcaagtccagaggccatccaaggcgctatggaaactacgggcatcgaagcggccccgatttaataaaccctcactattgcgagacacacgttctgccaagcaagtacatctgggaaacctcggatagtgcccgaggcgtgtgtctctccattttctaaaggagacccaatgagcaacgaatcccaagctgacgtctatgcacacttcggcgtgaatagcgctgtgatgaccactaccaacatcaccgagcatgagcaagcgatgctggcaatgcccgtgtctgttcgtgatggcgatgactccatcgagatgcactacgaggacgccgaagaaggctccaacgagctgcaactggataccggcgaggacaactctcaagagctggaattgacgaacgaggagggcactgacgaaggtgctgactccgatgagttcgtccctctgggcgaacctgacgctgacctgatcgaagcctctgaggccgtcgatgagtacgctgatggattcactcagatgcgcgctcaagcgatcaaagcgggcctgccacaagaggtcgctgaccagatcgaggccgagtatgaagctgacaacaaactctctgaggcgtccttaaaggcgctggagaaggttggctacagccgtggcttcgtgaagtcgtttatcagcggtcaagaagcactggctcaaacctatgtggcccagatccagcaatacgctggtggtcccgagaagttcaaagccatcgtggctcacatgacggccaactcccctgatgctgttgaagcattggagcgagccatccagaaccaagaccttgcgtccatcaagacgctgatcaatctgggcatggcgagccgcaccaagaagttcggcaagacaccggaacgtagcgtcactaagcgtgcccctgcaagtggtcctaaacaggcccctcaaggtccacaaggctatgcgtctcaggccgagatggtaaaggcgatgggagactcccgttacgctaccgacccatcttaccgtgcccaagtcgaagcccgagtgctgcgcaccaactggtaattaataaaccctcactattgcgagagatacctatccgattccttcggaggatctcttgcgcccttaagaatttcacaaaggagaactaatacatggcgaacatgaatggcggtcaacaactcggcgcgaaccaaggcaaaggccagaaccctgctgacaaactggcgaacttccttaagctgttcggtggcgaagtcctgacggctttcgtccgtcgctccgtgaccatggacaagcatatggttcgtaccatccagaatggtaagtccgcttcgttccctgttatgggtcgtaccaaaggttactacctcgctgctggtgagaacctggacgacaagcgtaaagacatcaagcactccgagaaagtgatccagatcgacggtctgttgacctcggacgttctgatctacgacatcgaagacgcgatgaaccactacgatgtccgtgctgaatactcggcacaactgggcgaagctctggctctggccgctgacggtgctgtactggccgagatggcgaacctgtgcaacctgcctgccgctaccaacgagaacatcgctggtctgggcactgccgttgttctgaacatcggtgctgctgctgacctcgttgacgttgaggctcgtggtaaagcgatcctgaaaggtctgactctggcccgtggccgcttcaccaagaactacgtccctgctggcgaccgtcgcttcttcacttcccctgacgactacagcgcgatcctgtctgctctgatgccgaacgctgccaactactcggcactgatcgacccagagaccggcaacatccgcaacgtgatgggctgggaagttatcgaagtcccacatctggtcgctggcggtgctggtgatgacgacctcggcactaaccagaagcacgccttcccggccactgctgctggcgatgtcaaggtagctcagaacaacgtgatcggcttgctggttcaccgttcggctgtcggcaccgtgaagctgaaagacatggcgctggaacgcgctcgtcgtcctgagtaccaagctgaccagatcatcggcaagtacgcgatgggtcacggtggcctgcgtcctgaggctgctggtgcgctggtcttcaccccggctgcctaaagccaactaaccccttggggctcctaaccgggctccttggggttttttttcattcaacgaaaggagatcaacatggcctatgaatcggtcctcgactctgatgacgaactcgatgctgtcaatgacatgctcgctgccatcggtgagtcccctgtaagttccctcgaaggtgaccctaacgctgacgtagcgaactgccgtcgcattctctccaaggtcaaccgtgagatccaagcgaagggctggacgttcaacattgaggagggcgcgatccttctccctgacgccttctcgaagctcattgagtacctgcctgactacctgcgtatgaccacctcaggcggcaccctgtacatcaaccgtggtggcttcgtttacgaccgcaccgcgaagactgatgtctttgaaaacccaatcaccgtggacctgatccgcctcaagcaactctctgagatgcccgagtgtttccgctcgtacatcgtcgctaagtcctctcgtcgattccaaacccggttctttggtgctggtgagatcgagggctccttgcaggaacaagaggctgaggcttgggcatccatccaagagtacgagctggacttcggtggcttcaacatgatcacaggcgatgcgttcgtcggtggtatcaccaaccgctaaggagggcctatgggactcgtttcgcaaagcgtcaagaacctcaaaggaggtatctcgcagcaaccggacatcttgcgtttctccaaccaaggtgccatgcaaatcaatggctggtcctcggagactcagggtctacagaagcgaccaccgaccaagatcatcaagcgtctgtacagcactggcgcactgggcgtgaagcctctggtccacatgatcaaccgggactccaccgagcaatacttcgtgtcgttcttcgggtccggccttacggttcacgacttggctggcaatgagtatctggtccgtggttacaacggctacgccaactgtgcgaaccctcgggatgacctgaggttgatcaccgtggccgactacaccttcgtgaccaatcgtaagactgtcactcagttggtcggtacgctgactggtgctggacaacctaacgtgaccactcgtgggcttgtgaacatccgtggtgggcagtatggccggaccatgcagatcctcatcaacgggggcgtctacgggaacatccagatgcctaacggttccgctgagaaggtgcctgctgggcagccttacgctggcatgaaccaagtggacatgacggacgccaactggatcgcctcgacgatggccgctcagatcaacactgcgctcaacgcctcgggctggtcggcaacctctggccccggctgggtcatgatcaccgctcccggccccggtgggtttgtttcgctacagaccaaggatggatacggtgaccagctcatgaacggcttcatctaccaagtccagacgttcaacaagttgcccgctcaggcccctgatggatacctcgtggaagtcactggcgagtccgctcgcacaggcgacaactactgggtccaatacagcctcgctggtaaggtctggaaggaagtggcgaagccggggatcatcgctgggttcaatagtgcgaccatgcctcacgccctcatccgggccgctgatggcaactttgattggaccccgctgacatgggatacgcgccagtgtggtgatgatggaaccaacccaatgccgtcattcattggtgatcggatcaatgacatcttcttcttccgtaaccgtctgggcttcattgcaggcgagaacgtgatcatgtcgaggaccgctaaatacttcaacttcttcccggcctccgtgagcgctcttagcgatgacgacccgattgacgtagcgatctcgcacaaccgtgtgagcatcttgaagtatgccgttccgttcgctgagcaattgctgttgtggtcggaccaagcccagttcgtattgtcgtccgctggggttctctcctcgaagaccattgagttggacttgacgactgagttcgatgtctctgatggtgcccgtccattcggtattggtcgcggggtttacttcgctgcacctcgggcctcctacacgtccctcaagcgctactacgcgatccaagacgtgagcaacgtgaagtccgctgaggatgtctccgcacacgttccgagctacctgccaaacaccgtgttcaatctggcggggtcaggaaccgagaacttcgtgtcgatgatcagtaacgggcaaccgggcaacctgtacatctacaagttcctgtacctcgacgagatcctccagcaacaatcgttctcccactggaacttcgggaccaacgttaagatcctcgctgcgtactcgattggctcctacatgtacctcatgttggatcgccctgaggggatcatgatggagcgcattgagttcactcagtccaccatcgacatcgctcaggagccctaccggacctacatggaccagaagaagctcatccagatcggtgcctatgacatcgacctccaccgtagcttcgtgagcatcgaatccattctcggtggcctgccatcgggcgactccgtgttctacacgattgaccagcaaggcgtgatgcagcgacatgaaggtccatggccttcgggttctggcttgtcctttccgggcaaccgggctggtgagtatgtggtcttcggtcgtgagtacgagttccaatatgagttctccaagttcctcatcaagcagaccgctgacgatggctccacctccactgaggacatcggtcggctccagcttcggagagcatggttgaactatgagaactctggcgcgtttgaggtcaacgtcaacaacggctccactcagtacgtctacccgatgtctggtggtcgcctcgggactcaaacgttcctcggtgagctggctctggggaccgggcagttcaagttccctgtcaccggcaacgcccaggcacaacgagtgacgatcagttctgcaaaccctaacccactcaacatcatcggatgcggatgggaaggtaactacattcgccgttctggcggtatctaattgactggcatggtgggggtttatttaccctcactattgccctatgggggatctttatgattttacagaaagcacaacgctggcacctcgaagctgctgcacgagacctcagtcccggtgacctccaagagttccactcccacacggctgggcgcgatccacgagacaccatcccgaactgcctcgatgacacctcaatggtgatcactaagggcgctctggtggtggctgtaggtgggtccaaagattgcctctggtttgtgactaccaacgtggtggacctgctgaccaaggctgaacgtatggagttctatcggatgcttaaagggcatctgagcgtactcaggctgcaaggccatcaatccctgaccaacttcgtgtcagtggacaatcacgcccacatccgtctcctcaacgctctcggtgcgaccttcgcccgtgaacaccacatgagtcctgccggatgtcggttccgtcaattctggctataggaggtcaccatgtgtgaaccagtaagcatcggcatggctgctgttgcggtcgtcggtggggctatggctgccaaggacaaggccaagggtgagggtaacgctgaggatgctcaacgtcgcaccgcccgagagcaagtcaagcagaccaacatggctaacgccaacctgcaactgactgcccaagaccgccaagaggaggcccgagcgcaactcgctgaggtcaacatgcaggcgctcaagaacaaaggaacggtggctgctgccatcggtgagtcaatgctttcgggcaactccatcaagcgtattgcgaactcagtggatgtcgaggccagtcaacaaaagatggcgatcaccgacaactacaagcgcgactattcgtcgatctttgcgaaccagattgccaacgtcgagaacaccaagtcggccctcaaaggtcaggcccaagtgatcaagaccagtggtctgagtcatgcccttgggatcgtctctgcgggggccaatggctacgccgctgggtcgtcattaaaaggtcagatgaacgccaacaaggcaactggacaatccaacggtacagctaaaggaggaacttaatggctaatgaaattgcacgagctttagactcggcccaaatgggcggtaaggaacgccttaagggctccactgcgaccgtccagttccaagcctctcagcaacgcgctgacgtgggcaacaatggcttcgctgactccatggcgagcttcgtgaaggccggggcgaatgcctatggcacctacgctcaggacaaggcgaagaacgctcaggctgagtcggacaagatcatccggtcgatgtccctccagcaacgccgtgaggctatcgcagcgggaaccctgcacctacaggatgaccctgacgtgatgaacgtcctgcgtcacgacactggccggacggctgcctttgaggtggagtccgagatccagaacaagctcgcctctggtgagttcgacaaccaatcccgtgaggaactggatgagtatcgccggacccgtctggagatggtctctcagtcctacgctcaggaagcgggtattgaccctaacgatcctgactaccagcgtggctttaacgccgacatcgtgaagcgtaatgcgggcctattcgacttgcatgaccagcgacgttcccagcgttacattgctcagactgtggtcaacacgcgtggcgacactggtggtcttctggatgaccctgagttcatgcgaggtccgggctctggcatcgagatggctgcctacttcaaatcgaaggcgtcctctggggcaatcccaacggaccaagcgctcctcgattcagtcaacctcgtgatcaacgatgcggtccagaaggaccacggatcgaccttcctcaagaacttccgagatcagacgatcaccgtgatggggattgagcagaaggtcggtgacgtgatcggtcaggagaaatacgacaacctgatcgccaagtccgctgaggccacctacaagcgcaaccaaccgaagttcgagaagttccaactggatctcgcttcggctgaggctcaggctgacccggctcgtggctgggacatgatcaatcggatcgaggccgagaataagtggattcaggatggtgatggcttcactcagcaaaagcaggcggtcaccagtaccaagctcgccatgctggcaaagatgaaggcccacactcaggcgacccttaaggcaaccgaggaggcaatgcagacggacaaccgcttgcaggccatcgacgaccgctacaaggctcgccgtaatggtgccctcttggggaccgctaagcaggacatgcctgtcgatgccaacactggagagttcaaggagtccgactgggcgacctacgctcaaaagaagctggctcagatcgaggccatggacatccctgtggagcagaaggatcttgagcgcggtcagctcctcaaggacgaccacgagaatggtcctttccgtcgaggcttccaaacgctgatcgacgatgcagccaaggaatggcaaggcgctgttcaattgggcgaactcggggactccccaaagatcgaccaactggcacgggtctatgcccagcaaccggaactcattgcgtcactctatcctgagcgcgctggcttcatcgaaaagatgaaccagatgaagcacgttgggattaacccatcggtcctcattgcggctgacgtgaagaactccaagctgaccaaggaggagatgatccaacggaacatccaatgggacgccctcaagagcgaccctaagaacaaagacctctcagcgattccgaacgacatggacaccatggctcgttctctctatgacgccttcaacgctgcaactggcgaccctacggctgcctccaagttgctctccaactggctctcgaagaacaccgttagcttccaagctggcgatgacgacgaggatgtccagaccggctaccaagggatgatcaacaagaaggatctcatggcagacccgaatgacgttaactcgtgggagcagggtaaggccatcgttgaggagaccgttaagggcatcaaggctgctgacccgtactgggctgactcgcctgtgaccatcaccgcttcccgcactggtgacatcaagatcgccaccctgactggtgaggtcgtgaccatcaagaagcaatccctccagcttatctacagcgctcgccgtcaggcggaactggatgctcagaaggccaacaaggctgctgagtacgatgaggacgtgaaggacgcacaacgcaatcaaggtctctacaaagactttatccgagggggtcgtggccctctctaatccaatttaggaggaacacatggctaagaaaacctacgctgatgtcaaggccgctggcacgccttacgatggtttgattcgtgaggccgctgatgccaatggcgtgagctatgactacctgcacaaaaagatctttaacgagtccagcttcaaccctcaagctcagtcaccgactgggcctcggggtctgggtcagttcactcgtgccactggcaaggcgtatggtctcgttacagacgaggacttcttcgaccctgccaagtccatcaatgcgtccgctcgccacactgcggacctcctcaagacctacaaaggggactacctcaaggctgcccttgcgtacaaccaagggaatggccgcttaggggctccccagttgcaagctctggatcgtggtgacttctccaagatcgcccctgagggtcgtcagtacatggcgaaccttctggacgtggctggtgactccccgtcccgcaagtggttcgagggtccagatgccccaaagctaaccgctgagttccaagaggctacccaagggatctcagcaacaccatccgttgaacaaggtagcctcggtggaaacattgggatgaacatcgggggctccactgcgcctgcccaagagaagtcgttccgccaaatggagatcgagcagaacggcccagagaagggcgcatggtacggctcctctgaggccatgttggctgccttgaagacctcgcttcccggccagatctaccggaacatcaccgtcgaggatcatgaccctttggagtggatgcaggacacgggcgaccgtgagtggtccaaggaggactacgaccacatccgtaatgaaggtgtcgattcgcaatacttcgacttcattggtgactacacccggtacgacaagcgcaagctgcctgaggccatcgctctcgccaaagagaacatggctcacgacaagaccatcacatccgctggatggggcggtcaactggctgctggtggcgttctcgctgctactgatccactgacctacgtccctgttccgggcaccgctctgcgcacctttggtggccgtgtgttggctcaggggacgttctcctctggtgccgctgtggctggtgagggtatccgtgaggcgaccactgggatcgaaggtcactacgctaccgctgctgtaggtggtgctgtgatcggtggcaccatggctgctgtcttggacaagtggattgccaagtcactcgttaagcctgggcgagaagacatgagcgatgaggaactcgaaaaggttcttgctcgccacggtgaggctggcctccagtccaacgatgtcaaagtcgatgaggacatgttggcctccgctcgcccctctaaggttgacgatgagatggacgatgagtacctcgaaaagatcctcgggatgcacggtgagcgctcccacaaacaagagggtcgaatggaagtctctgacgacaccgttgagggcatccttgcgaggcaccgagagtcgagccaaccgaacgagttcatgggtccaaccatccgcatcaatgcccgtgagcaagctcgtttggctggtgctgacgaccataccgttatggcatggaagtccgatgagacccctgatgaagccttcgggattcagtacatggaccacccaaaggaaccgggcgctgtgcgtctgcctgatggttcgatcctctctgccagcaacccgctgaaccctaagctcatcaaagcgatggcctctctggagcctgagcgagccgctgctgggttcaagtttggtggcctgactgagatcggtctgatgctactgcgtagcgaggatgaggagctgagaggtattggcgctcagttgttccgctcgcccactggtggtgtctctgggtccaacggtaagtttggcgctgtggcttctgacgtgatcgagcgtgagcgtggtcaagatcatgtggctctgaacgccatggtcgatgctcaacaagaggccatgaaggacgtctcggtgaagaccctgcccggtggccgtcaggctcagcgtgagtatgtggatcgccggatcgctgaggctatcgaagaccctacaggggccaagctggctcagctcactgaggccgagaagaagtacgccaaggtcgtagaggatcactttgtccgcaaagagaactcccttgagaaccctgcgcagtacggcaacatggatgccacttcgatcatgcctcagacccgccactctggtcggtacatcccgaacatctacgatgacgccatcaagctgctcaacctccaacgcttcggcggtcctgagggtttgcagaaggcaatcgttgagagctggatggcttcctatctgagccgtgctgctgtgaaaaccagagtggacaagatgatcaaggagtcgctggagaagaacggaaaggtggcaacacctgaggacatcaagaaggccgttgtcgagtacgcctacaacaaggcatacggtatcagccacacgactgacttcaaccgctcctctctgatcgacgataacctcgaaggtttggtgggtcaggatgccaacaacttcctcgaaggccgtcacctgtttgactcggacgtggctgtatcgctgagcgatgggacaaccttctcggttaacgacctgcgtatctttgacgttcctcagatcacctcctcgtacaaccgtcgagtaaatggggacatcgggatcatggctgcaactggtaaggacaccactgccctcaaggacgcgatcctcaagatcaaggccaagaatggcaacactcaggaagtggaagccttgcaggagtccatcaagctactcactgggcgctcacgtcgagaccctgactcagcggctgcaacactggctcgtgccttgactgacgtttcgttcttcaccaagaacgcctacatgggcgctcagaacgtcactgagatcgctgggctgatcactaagggccacactcggatgctcatgaagggagtcccattcctccgtgagatgaccacatggggctctaagatcaaacctgagcaactcaaggagatgcacgacatgatcttcggtcgggagctggatgacctcatccgtcctcgccgtgctgacatcgtgcaacgcctgcgtaaccaaggctacagcggggccacggctcagactgtgggcaccatcaagttcgccactggtgagctggctgcccgttcgcctttcaccaagttcctcactgagacctccaactacatcctcgatgctggtcggcaaggtgtccttgtggacctcgtgaaccatgcgctctccgggaagacctcgaagctgttcaatgaggatcgactgcactcgatgtcgatcaccaaggctcagttcggtgatgtgacgaatgccctcaaggagcatctcgtggctgatcccaaaggtggcttcaagatccgtgatcgggccaagttccaacaagaccctcgggtaatggacatctggcggattggtgacaaggtggccgatgagaccatcctgcgtccccacaagctgagcaacaccgatgccattgcgcagaacgcttgggtcaagttggcgatgcagttcaagaacttcgtcctgcgttcggtaaacagtcgcctcctacggggcttctataacgccaccaagaacaagcaggccatcgaccaagcccaacaagtggcgatctcgatgggtctcgcctcgggcttctatgtggcccagcgctacgtccaagctcaagggatgcctaaagaggaacgccgtgacttcctgtcgcggtcactggacatgaacatgatcgcttatgcagcgggctctcgtagctctcacgttggtgcccctttgggtatcgccaactttgctctggcccctctggggttcgatgctgctgctgctgtgcggacctctgttctgcctcgtggtcctcagtacaccgaacggaaccgggctgtgaaatattccccgctccgctcctcgggcatccaagacccgctctcgaagttcgctgagcaagtacctggcctcggagtcctcgggtcgatctatcagattggcaatggcaccgctggcgtgttccgcgatgaaggtcgggctcaggatcaggactacaagtctgcgatctacaacgggttccgtaacctcgtgccgaacgaccctgcaactcagaaggtcaccaacatgcttttccaagagatgggcatggagtacggcaagcgcggccagaaggtccgttaataacccctcactattgggatacatcaactcacgccctgccctaacccggtggggctttttcattaaggagaccacatggcaactaccaccaagacggtgaagacgtatgccctcaacggttccctcaaggacttcacgattccattcgagtatctcgctcgtaaattcgtgagtgtcaacttgatcggcgcaacccggaaagagcttgtactcaacgtagacttccgcttctccactccgaccaccatcaccaccttgcgtggttctggctggggtccggctgacaacttcgacctgatcgagatccgccgttggacttccgccactgagcgtctcgttgacttcgctgacggttcgatccttcgtgcctacgacctcaacaccgctcagattcaatcgctccacatcgctgaggaagctcgtgacctcacggctgacacaatcggcgtgaacaacgatggtcaactcgatgcccgtgcgcggcgtattgtgaacctcgctgatgcgatcaaccccggtgacgctgtgaccctgcgccaagagcaacaatggggcggctcagcgctcaaccaagcgaacctctcggctgcctctgcggctgcctctcaggcttcccggctggcttctgaaagtgcccgcgatacgtccatcacttacgctggcgaatcgtacacccatcgaattgcctcggagaccgctaagaacgcctcggctgcctctgcgacaaactctgagttgtccaatcagactgcctacaagtgggccaacaaccctgagaacgtggtggtcaacactgggcaatactcagcgttccactgggtccagaaggcaatcgcccatgtggctaccgctctgggctacgccaacgctgcctcatcgtctgccactcaggctgcccaaaaggtggctgacgctcaggctcaagtgagtctcgctgctgctcaggcgaccatcgcaaccaacaaggctgctgaggctgctacaagcgcttcccagttgggcggtgcgattggtattggtgacaacatctcgtccacttcgagcggtgacgggaactggaaggtggtctttaagggcatcgtacaggctgtcggtgcgttcttcggtaagcgctttgaggcccagccttacaccgagtcgactggcttttccagccaatggtccacctctgcgcccttcttgactcaggaaggtgtactcgacaacacctcagcttactacccaatcatcaaaggtaagtatggtcaggctggagcaggccatgcgccgtccatgggcgtcctgacgagaaccgatggtaaccacgccttgacactccactggggcaactcagcggggactggcccagcgctgcttcaactgaacaaagatggcctgaacgcctccttctcagggagcatctcatcggggtctactggtgcaatctactcgggtactggtggggtttacgactcaggtaaccgcgtgtggtcaactggtaacttcaacccagcctacaagctgagtggtactggcgggaccaacacgatgggtaacaacaaccaagtctgtggcgtcacctacacgaacctctcggctgccaaccaagtttacaacggtgcctttgagatccgtgagaatggtctggtaggcaatggtggaccagctcccggtcacatctacaacgctcctgcgattgccttccactggggcgcgaccgttgtttctaagctgatgatgaacgctgctggttccttgtgctggggcaacccttcctcgcagttcatgcagatctccccggatgggaacatcttcggttccgttttcggtaaccagtgggcgaccacctacatctacaacaccgccaacgagcgtgcaaacgcttgggcagttcaagaagcccgcaacgtcaacaacatcggcatcgccatgtccagtctgcgggtcaactcgctgggctgccacatgctggctctggctcacaacaactcgggcgtggagtggaacgaaggtgtcgctggcggcaacctcactggcaccaacactggtggcacttacttcgctggctacaacttggccggtaactacgttcggatgggtaagttggttaacgctgacggcgcatcccctgactccgtgaccctatacatgcgctatgcgtaaggaggattaatggctaacagatctatcgtggacgtgaagaatgtccaatggtgctgccctaacaaggatgcagcctactgcctcgtaaagttctcggacatcgaggactacatcgagtacaccgctgtgcgtggcgacgaagttgcgcatggtaatgaactattccagatcatcgaccggggtctcgctggggacatccctgagtattccggtcccgaccaatcgcagatcgaggcatggaacctgctcatggaggaggtctctgcgcttcgtgtggagttcgacaagatcatccctgaggtccaattgggcctcgctgcacctgagcgtgtagagcgcgccaagtacctctatggccgcatcaaggacatcgagtcgtaccacaaagcgacctatgacatgacgttctgctacgtcaaccgtgaggtgtcctaatgggcatctctatcgacttcaacaacggggtggtgcaagccactccagtagtaggtgctgctgtaactgacgtgacggcccggttgtttctgggcctttcaccaagtgagtggttctacgcatccgccgttttgtactccctcgtgatgactgtaatcgtggtttacaagaccgttaaagaagaacgccgaaaagacaaggaggctgagaaatgagtgatgacttactgatgcgcctgctggtcgcgctggacactgacatggcgaagaacatgttggctgacctccgtgatcctgagcgtagaacgcctcagctctacaacgctgtgggcaaactgctggaacgacacaagttcaccatcgccaagctgcaaccggatgagtcccttctgggcgatctcgcttcggctctcgatgagatccctgagttaactgacgacgagctgtacgcctcggacgttcgccactaaaggaggccctgcatgttgaaccttaaagagttcgtcatgtggggccttttggtttgcacaggcttaggtctgacgtatgccaaaggtcactctgacgcaaccgacacactgaccctcaaacatcaaactgaacaactggcggctgcccgtcaactggaggtggaacgtgaaacaacccaaagagccctcgctgatgtctcgaagaactggcaagcctatctctcaacgagtaaggcatctgctgatcggactattgctggtctgcgtagcaatggtatcagcctgtcagtcgccctcgcagatgccaccgtcaagtgcgtcacggctgacggtagacccctcgctgatggtcgcgccgagctacgagaaagcgatggtcgatttcttatcgaacaagcccaacgagcagacgcccaagtgaagggcctgcaagattccattaagaccatccaaggaggaactaaatgagcgcaccccgtaatgggggcgacgacatagcgttaatgaaaaggtcattcgtggcctttctttttgtcctgtggagagccctcaacctacccaaaccaaccaagtgtcagatcgacatgtccaagaagctcagctctggagacgaacgtcgatttatccttcaagcattccgaggtatcggcaagtccttcatcacctgcgcattcgttgtgtggaagctgtggggcaacccggacctcaagttcatgatcgtgtccgcttccaaggaacgggcagacgccaactccatcttcatcaagcggatcattgagctgctcccattcctccacgagctgaaaccacggacgggtcaacgagactccgctctggccttcgacgtgggtctcgccaagcccgaccactcgccctcggtgaagtcggtaggtatcaccggccagctcacaggttcccgtgcggacatcctcattgcggatgacgttgaggttccgaacaactcgggcacccagtctgcgcgtgacgccctgggagaacttgtgaaggagttcgatgcgatcctgaaaccgggcggtacgatcatctatctgggcacccctcagaccgagatgaccctctatcgtgagctggaaggccgtggctacgtcactaccatctggcctgcgagataccctaaggatcagaaggattgggactcctatggcccacggctggctcctatgctggaggctgagctgcgagctgatggttccctgttctgggcacctactgaccctgtacgcttcgacgatacagatctaagggaacgtgaactctcctacgggaaaggtggcttcgccctccagttcatgctcaaccctaacctcagtgacgccgagaagtaccctctcaagctgcgtgatttcatcgtagggacgttcgacatgatgaaagggccaaccaccctgacatggatgccaaacgccaacaacgaggttaaaggcgttcctctggtgggtctcaaaggcgaccgcttccaccgctacgaagctgtaggtcaggccactgcgcagtacgctcagaaaatccttgtgatcgacccatcggggcgcggtaaggatgagactggctatgcagtcctgtaccagctcaacggctacatcttcctgatggacgctggtggcttccgtggtggctacgaggacacaaccctccaagccctctcgaacctcgccaagatctacaaggtcaatgaggtcgtgatcgagggcaacttcggtgacggtatgtacctcaagctgatcagtcctgtgctgaccgctacatggccgtgcgcgatcactgaggtcaagtccaagggtcagaaggaactccgcatctgcgacgttctggagcccgtactgggcagccataagctggttctcagcgaggccctcatcgacaaggactaccggacagcgctcaacgctgacgggaccacggacatcaagtacagcctgctatatcagctctctcggatcacccgtgagcgtggctcgctggcccacgatgaccgcttggatgcccttgcgattggcgtccagttcttcactgaggccatggagaaggattccaagctgggcgagtcggaactgatggctgagttcttggaggcccagatggagaaccaactgatgggctttgaggacgtcagaaggatcgcaatcagtgactccgtggacatcatgttcgacgatgaaggctcaatgaccaactatatgggctggtaggatgtctgcatgatcgaagcatgatcgacgaagtttatttaccctcactattgggagaggcccaccctaagatacctaagagattcctaacaagatctcagcaaggttcttctggtggtgcctctaacctttgggttcctcaggatgaggtccgaccaaaggaactggaccaaggatggttatcaactatgatcattatcaagaaggaggtcaaaccatggacgtagagaaagccaccgtgctgctcgtactcaagcggttggctctctccaagaccacctacaagctcatcggcaccttgctggtggccttaggtgtcctcaatggcagtgatgtcatgaacatggtctctggccttatatgtgtggcatctggtggctgcgtagagtgaccgacacgaccaatttcggtatggttacaccctacctcattggtcagtttaagaaagcccttaggtgtcctcataggcccttagggtcttccttaggataaccgatagatggcacttgcatgaacccattggataccttaggatgtcctttaagaatctgatagaaaaatctgaaagggcacctctcatagacaaacgcccacgaatccccccatagggcctctctcagccatcccaagggctctgctccccatagggcatctcaatgatcatctgagggatacgatgaggtgactcaatggtggctacatggtggtgatccttaggtggttcgttgaggtacatgatggggcctaaagggtgagctgtcaacactggggattcatacagtagtccatctgtccctatctgtatcagcaatccttaggctgctccttaggctgctccttaggtcactcccagggtgatcatgtgacgcctctccttagggccatccttagggctcctataaggtgcctgtagaccctgctccttaggatggccttgagttgcctatatagaggcgatgcgtagcctatgagttgttacaggctgacctatacactggatgaataaacaggttgacggcgatgctcagttctatacaatgggccacatcaacaacgagacacggcctaacgggtgtctctgagttggtcgcttagcttagtagcatctgacctgcgatcatacgtgtgccaagggtcttaagggtgacgaacgataagcgacacaagggcagaaacaaacgcttgacaacaccgcaacacgctgtagaatacgccacatcaacaacgaaacacgcaacgagctacctgagcagatgtcatgagtagggtgggtcgggtgaggtcaaagtcaccagcatgggtcgcaagaagggcaacgaattggccgataaccacggcctaacgggcacccttacgctctttaacaactcggactgcaacactacgcactgagacgggatgacgtcttaactggcttgctcagaccctcggtgcgtagcagtgaaaggaaatacagcaagagggctctcgtgtatctaagcattagcacgggacgtggagagccttcgtctgtatctcttaacacacaagcaaggagcatcaccatgagtacacgcactgatcgtatacgcactgagctggctgacctcgatgcacgtattgtgaaggctgaggctgagcatcaagccgctaaggccatctttgggcgctttgagggctctgctgctcatcctatgtgggagaagctgcgcaatgaggttgactcaacgctgactcgctgccgtgtccttgaggccgtgtggcaccgcactaaggctgacctgctcgaacaactcaacgctgacaaggagtaacaccatggacactggctaccttcaacatggcaaggcaccgggaccattccgcaccgagaaggtgagcatcaagaacgaacacggtgatcgctggcttgccttctatgagggtcgctggcggcgggttcactaccaagttcatcgcttgttcatcgtgtacaacggtgagcatatcaccatcaccatcgaaggtgtctgagcgattcgctgtagggccttccttgagggctctatgggaacaactcaacgtcac

SEQ ID NO: 7 - DNA, 41236 bp, unidentified
  misc_feature 1..11: note = bacteriophages nucleic acid sequence
  source 1..41236: mol_type = genomic DNA
cagtgttggtgccagtgaggttgccgccagcgacaccttcgttccactccacgcccgagttgttgtgagccagagccagcatgtggcagccaagcgagttgacgcgcagactggacatggcgatgccgatgttgttgacgttgcgggcttcttgaactgcccaagcgtttgcacgctcgttggcggtgttgtagatgtaaccggtcacccactggttgccaaaaacggaaccgtagatgttcccatccggggagatctgcatgaactgcgaggaagggttgccccagcacaaggcaccagcagcgttcatcatcagcttagaaacaacggtcgcgccccagtggaaggcaatcgcaggagcgttgtagatgtgaccgggagctggtccaccattgcctaccagaccattctcacggatctcaaaggcaccgttgtaaacttggttggcagccgagaggttcgtgtaggtgacgccacatacagcgttgttgttacccatcgttgtggtgccaccagtaccagacagcttgtaggctgggttgaaggaagcggctgaccaaacgcgactacctgagtcgtataccccaccagtacccgagtagattgcaccagtagaccccgatgagatgctccctgagaaggaggcgttcaggccatctttgttcagttgaagcagcgctgggccagtccccgctgagttgccccagtggagtgtcaaggcgtggttaccatcggttctcgtcaggacgcccatggacggcgcatggcctgctccagcctgaccatacttacctttgatgattgggtagtaagctgaggtgttgtcgagtacaccttcctgagtcaagaagggcgcagaggtggaccattggctggaaaagccagtcgactcggtgtaaggctgggcctcaaagcgcttaccgaagaacgcaccgacagcctgtacgatgcccttaaagaccaccttccagttcccgtcaccgctcgaagtggacgagatgttgtcaccaataccaatcgcaccgcccaactgggaagcgcttgtagcagcctcagcggccttgttggttgcgatggtcgcctgagcagcagcgagactcacttgagcctgagcatcagtcaccttttgggcagcctgagtggcagacgatgaggcagcgttggcgtagcccagagcggtagccacatgggcgattgccttctggacccagtggaacgctgagtattgcccagtgttgaccaccacgttctcagggttgttggcccacttgtaggcagtctgattggacaactcagagtttgtcgcagaggcagccgaggcgttcttagcggtctccgaggcaatccgatgggtgtacgattcgccagcgtaggtgatggacgtatcgcgggcactttcagatgccagccgggaagcctgagaggcagccgcagaggcagccgagaggttcgcttggttgagcgctgagccgccccattgttgctcttggcgcagggtcacagcgtcaccgggattgatcgcatcagcgaggttcacaatgcgccgcgcacgggcatcgagttgaccatcgttgttcacgccgattgtgtcagccgtgaggtcacgagcttcctcagcgatgtggagcgattgaatctgagcggtgttgaggtcgtaggcacgaaggatcgaaccgtcagcgaagtcaacgagacgctcagtggcggaagtccaacggcggatctcgatcaggtcgaagttgtcagccggaccccagccagaaccacgcaaggtggtgatggtggtcggagtggagaagcggaagtctacgttgagtacaagctctttccgggttgcgccgatcaagttgacactcacgaatttacgagcgagatactcgaatggaatcgtgaagtccttgagggaaccgttgagggcatacgtcttcaccgtcttggtggtagttgccatgtggtctccttaatgaaaaagccccaccgggttagggcagggcgtgagttgatgtatcccaatagtgaggggttattaacggaccttctggccgcgcttgccgtactccatgcccatctcttggaaaagcatgttggtgaccttctgagttgcagggtcgttcggcacgaggttacggaacccgttgtagatcgcagacttgtagtcctgatcctgagcccgaccttcatcgcggaacacgccagcggtgccattgccaatctgatagatcgacccgaggactccgaggccaggtacttgctcagcgaacttcgagagcgggtcttggatgcccgaggagcggagcggggaatatttcacagcccggttccgttcggtgtactgaggaccacgaggcagaacagaggtccgcacagcagcagcagcatcgaaccccagaggggccagagcaaagttggcgatacccaaaggggcaccaacgtgagagctacgagagcccgctgcataagcaatcatgttcatgtccagtgaccgcgacaggaagtcacggcgttcctctttaggcatcccttgagcttggacgtagcgctgggccacatagaagcccgaggcgagacccatagagatcgccacttgttgggcttggtcgatggcctgcttgttcttggtggcgttatagaagccccgtaggaggcgactgtttaccgaacgcaggacgaagttcttgaactgcatcgccagcttgacccaagcgttctgcgcaatggcatcggtgttgctcagcttgtggggacgcaggatggtctcatcggccaccttgtcaccaatccgccagatgtccattacccgagggtcttgctggaacttggcccgatcacggatcttgaagccaccttttggatcagccacgagatgctccttgagggcattcgtcacgtcaccgaactgggccttggtgatcgacatcgagtgcagtcgatcctcattgaacagcttcgaggtcttcccagagagcgcatggttcacgaggtctacaaggacaccttgccgaccagcatcgaggatgtagttggaggtctcagtgaggaactttgtgaaaggcgaacgggcagccagctcaccagtggcgaacttgatggtgcccacagtctgagccgtggccccgctgtagccttggttacgcaggcgttgcacgatgtcagcacggcgaggacggatgaggtcatccagctcccgaccgaagatcatgtcgtgcatctccttgagttgctcaggtttgatcttagagccccatgtggtcatctcacggaggaaggggactcccttcatgagcatccgagtgtggcccttagtgatcagcccagcgacctcagtgacgttctgagcgcccatgtaggcgttcttggtgaagaacgaaacgtcagtcaaggcacgagccagtgttgcagccgctgagtcagggtctcgacgtgagcgcccagtgagcagcttgatggactcctgcaaggcttccacttcctgagtgttaccattcttggccttgatcttgaggatcgcgtccttgagggcagtggtgtccttaccagtggcagccatgatcccgatgtcaccatttactcgacggttgtacgaggaggtgatctgaggaacgtcaaagatgcgcaggtcgttaaccgagaaggttgtcccatcgctcagcgatacagccacgtccgagtcaaacaggtgacggccttcgaggaagttgttggcatcctgacccaccaaaccttcgaggttatcgtcgatcagagaggagcggttgaagtcagtcgtgtggctgataccgtatgccttgttgtaggcgtactcgacaacggccttcttgatgtcctcaggtgttgccacctttccgttcttctccagcgactccttgatcatcttgtccactctggttttcacagcagcacggctcagataggaagccatccagctctcaacgattgccttctgcaaaccctccgggccgccgaagcgttggaggttgagcagcttgatggcgtcatcgtagatgttcgggatgtaccggccagagtgacgggtctgaggcatgatcgaagtggcatccatgttgccgtactgcgcagggttctcaagggagttctctttgcggacaaagtgatcctcgactaccttggcgtacttcttctcggcctcagtgagctgagccagcttggtccctgtagggtcttcgatagcctcagcgatccggcgatccacatactcacgctgagcctgacggccaccgggtagggtcttcaccgagacatccttcatggcctcttgttgggcatcgaccatggcgtttagagccacatgatcttgaccacgctcacgctcgatcacgtcagaagccacagcgccaaacttaccgttggacccagagacaccaccagtgggcgagcggaacaactgagcgccaatacctctcagctcctcgtcctcgctacgcagcagcatcaggccaatctcagtcagtccgccgaacttgaacccagcagcggctcgctcaggctccagagaggccatcgctttgatgagcttggggttcagcgggttgctggccgagaggatcgaaccatcaggcagacgcacagcgcccggttcctttgggtgatccatgtactgaatcccgaaggcttcatcaggggtctcatcggacttccatgccataacggtagggtcgtcagcaccagccaaacgagcttgctcacgggcattgatgcggatggttggacccatgaactcgttcggttggctcgactctcggtgcctcgcaaggatgccctcaacggtgtcgtcagagacttccattcgaccctcttgtttgtgggatcgctcaccgtgcatcccgaggatcttttcgaggtactcatcgtccatctcatcgtcaaccttagaggggcgagcggaggccaacatgtcctcatcgactttgacatcgttggactggaggccagcctcaccgtggcgagcaagaaccttttcgagttcctcatcgctcatgtcttctcgcccaggcttaacgagtgacttggcaatccacttgtccaagacagcagccatggtgccaccgatcacagcaccacctacagcagcggtagcgtagtgaccttcgatcccagtggtcgcctcacggataccctcaccagccacagcggcaccagaggagaacgtcccctgagccaacacacggccaccaaaggtgcgcagagcggtgcccggaacagggacgtaggtcagtggatcagtagcagcgagaacgccaccagcagccagttgaccgccccatccagcggatgtgatggtcttgtcgtgagccatgttctctttggcgagagcgatggcctcaggcagcttgcgcttgtcgtaccgggtgtagtcaccaatgaagtcgaagtattgcgaatcgacaccttcattacggatgtggtcgtagtcctccttggaccactcacggtcgcccgtgtcctgcatccactccaaagggtcatgatcctcgacggtgatgttccggtagatctggccgggaagcgaggtcttcaaggcagccaacatggcctcagaggagccgtaccatgcgcccttctctgggccgttctgctcgatctccatttggcggaacgacttctcttgggcaggcgcagtggagcccccgatgttcatcccaatgtttccaccgaggctaccttgttcaacggatggtgttgctgagatcccttgggtagcctcttggaactcagcggttagctttggggcatctggaccctcgaaccacttgcgggacggggagtcaccagccacgtccagaaggttcgccatgtactgacgaccctcaggggcgatcttggagaagtcaccacgatccagagcttgcaactggggagcgcccaagcggccattcccttggttgtacgcaagggcagcctttaggtagtcccctttgtaggtcttgaggaggtccgcagtgtggcgagcggacgcattgatggacttggcagggtcgaagaagtcctcgtctgtaacgagaccatacgccttaccagtggcacgagtgaactgacccagcccccgaggcccagtcggtgactgagcttgagggttgaagctggactcgttgaagatctttttgtgcaggtagtcatagctcacgccattggcatcagcagcctcacgaatcaaaccatcgtaaggcgtgccagcggccttgacatcagcgtaggttttcttagccatgtgttcctcctaaattggattagagagggccacgaccccctcggataaagtctttgtagagaccttgattgcgttgtgcgtccttcacgtcctcatcgtactcagcagccttgttggccttctgagcttccagttccgcctgacggcgagcgctgtagatgagctggagggattgcttcttgatggtcacgacctcaccagtcaaggtggcgatcttgatgtcaccagtgcgggaagcggtgatggtcacaggcgagtcagcccagtacgggtcagcagccttgatgcccttaacggtctcctcaacgatggccttaccctgctcccacgagttaacgtcgttcgggtcggccatgagatccttcttgttgatcatcccttggtagccggtctggacatcctcgtcgtcatcgccagcttggaagctaacggtgttcttcgagagccagttggagagcaacttggaggcagccgtagggtcgccagttgcagcgttgaaggcgtcatagagagaacgagccatggtgtccatgtcgttcggaatcgctgagaggtctttgttcttagggtcgctcttgagggcgtcccattggatgttccgttggatcatctcctccttggtcagcttggagttcttcacgtcagccgcaatgaggaccgatgggttaatcccaacgtgcttcatctggttcatcttttcgatgaagccagcgcgctcaggatagagtgacgcaatgagttccggttgctgggcatagacccgtgccagttggtcgatctttggggagtccccgagttcgcccaattgaacagcgccttgccattccttggctgcatcgtcgatcagcgtttggaagcctcgacggaaaggaccattctcgtggtcgtccttgaggagctgaccgcgctcaagatccttctgctccacagggatgtccatggcctcgatctgagccagcttcttttgagcgtaggtcgcccagtcggactccttgaactctccagtgttggcatcgacaggcatgtcctgcttagcggtccccaatagggcaccattacggcgagccttgtagcggtcgtcgatggcctgcaagcggttgtccgtctgcatcgcctcctcggttgccttaagggtagcctgagtgtgggccttcatctttgccagcatggcgagcttggtactggtgaccgcctgcttttgctgagtgaagccatcaccatcctgaatccacttattctcggcctcgatccgattgatcatgtcccaaccacgagccgggtcagcctgagcctcagccgaagcgagatccagttggaacttctcgaactttggttggttgcgcttgtaggtggcctcagcggacttggcgatcaggttgtcgtatttctcctgaccgatcacgtcaccgaccttctgctcaatccccatcacggtgatcgtctgatctcggaagttcttgaggaaggtcgatccgtggtccttctggaccgcatcgttgatcacgaggttgacggaatcgaggagcgcttggtccgttgggattgccccagaggacgccttcgatttgaagtaggcagccatctcgatgccagagcccggaccacgcatgaactcagggtcatccagaagaccaccagtgtcgccacgagtgttgaccacagtctgagcaatgtagcgctgggaacgtcgctggtcatgcaagtcgaataggcccgcattacgcttcacgatgtcggcgttaaagccacgctggtagtcaggatcgttagggtcaatacccgcttcctgagcgtaggactgagagaccatctccagacgggtccggcgatactcatccagttcctcacgggattggttgtcgaactcaccagaggcgagcttgttctggatctcggactccacctcaaaggcagccgtccggccagtgtcgtgacgcaggacgttcatcacgtcagggtcatcctgtaggtgcagggttcccgctgcgatagcctcacggcgttgctggagggacatcgaccggatgatcttgtccgactcagcctgagcgttcttcgccttgtcctgagcgtaggtgccataggcattcgccccggccttcacgaagctcgccatggagtcagcgaagccattgttgcccacgtcagcgcgttgctgagaggcttggaactggacggtcgcagtggagcccttaaggcgttccttaccgcccatttgggccgagtctaaagctcgtgcaatttcattagccattaagttcctcctttagctgtaccgttggattgtccagttgccttgttggcgttcatctgaccttttaatgacgacccagcggcgtagccattggcccccgcagagacgatcccaagggcatgactcagaccactggtcttgatcacttgggcctgacctttgagggccgacttggtgttctcgacgttggcaatctggttcgcaaagatcgacgaatagtcgcgcttgtagttgtcggtgatcgccatcttttgttgactggcctcgacatccactgagttcgcaatacgcttgatggagttgcccgaaagcattgactcaccgatggcagcagccaccgttcctttgttcttgagcgcctgcatgttgacctcagcgagttgcgctcgggcctcctcttggcggtcttgggcagtcagttgcaggttggcgttagccatgttggtctgcttgacttgctctcgggcggtgcgacgttgagcatcctcagcgttaccctcacccttggccttgtccttggcagccatagccccaccgacgaccgcaacagcagccatgccgatgcttactggttcacacatggtgacctcctatagccagaattgacggaaccgacatccggcaggactcatgtggtgttcacgggcgaaggtcgcaccgagagcgttgaggagacggatgtgggcgtgattgtccactgacacgaagttggtcagggattgatggccttgcagcctgagtacgctcagatgccctttaagcatccgatagaactccatacgttcagccttggtcagcaggtccaccacgttggtagtcacaaaccagaggcaatctttggacccacctacagccaccaccagagcgcccttagtgatcaccattgaggtgtcatcgaggcagttcgggatggtgtctcgtggatcgcgcccagccgtgtgggagtggaactcttggaggtcaccgggactgaggtctcgtgcagcagcttcgaggtgccagcgttgtgctttctgtaaaatcataaagatcccccatagggcaatagtgagggtaaataaacccccaccatgccagtcaattagataccgccagaacggcgaatgtagttaccttcccatccgcatccgatgatgttgagtgggttagggtttgcagaactgatcgtcactcgttgtgcctgggcgttgccggtgacagggaacttgaactgcccggtccccagagccagctcaccgaggaacgtttgagtcccgaggcgaccaccagacatcgggtagacgtactgagtggagccgttgttgacgttgacctcaaacgcgccagagttctcatagttcaaccatgctctccgaagctggagccgaccgatgtcctcagtggaggtggagccatcgtcagcggtctgcttgatgaggaacttggagaactcatattggaactcgtactcacgaccgaagaccacatactcaccagcccggttgcccggaaaggacaagccagaacccgaaggccatggaccttcatgtcgctgcatcacgccttgctggtcaatcgtgtagaacacggagtcgcccgatggcaggccaccgagaatggattcgatgctcacgaagctacggtggaggtcgatgtcataggcaccgatctggatgagcttcttctggtccatgtaggtccggtagggctcctgagcgatgtcgatggtggactgagtgaactcaatgcgctccatcatgatcccctcagggcgatccaacatgaggtacatgtaggagccaatcgagtacgcagcgaggatcttaacgttggtcccgaagttccagtgggagaacgattgttgctggaggatctcgtcgaggtacaggaacttgtagatgtacaggttgcccggttgcccgttactgatcatcgacacgaagttctcggttcctgaccccgccagattgaacacggtgtttggcaggtagctcggaacgtgtgcggagacatcctcagcggacttcacgttgctcacgtcttggatcgcgtagtagcgcttgagggacgtgtaggaggcccgaggtgcagcgaagtaaaccccgcgaccaataccgaatggacgggcaccatcagagacatcgaactcagtcgtcaagtccaactcaatggtcttcgaggagagaaccccagcggacgacaatacgaactgggcttggtccgaccacaacagcaattgctcagcgaacggaacggcatacttcaagatgctcacacggttgtgcgagatcgctacgtcaatcgggtcgtcatcgctaagagcgctcacggaggccgggaagaagttgaagtatttagcggtcctcgacatgatcacgttctcgcctgcaatgaagcccagacggttacggaagaagaagatgtcattgatccgatcaccaatgaatgacggcattgggttggttccatcatcaccacactggcgcgtatcccatgtcagcggggtccaatcaaagttgccatcagcggcccggatgagggcgtgaggcatggtcgcactattgaacccagcgatgatccccggcttcgccacttccttccagaccttaccagcgaggctgtattggacccagtagttgtcgcctgtgcgagcggactcgccagtgacttccacgaggtatccatcaggggcctgagcgggcaacttgttgaacgtctggacttggtagatgaagccgttcatgagctggtcaccgtagccatccttggtctgtagcgaaacaaacccaccggggccgggagcggtgatcatgacccagccggggccagaggttgccgaccagcccgaggcgttgagcgcagtgttgatctgagcggccatcgttgaggcgatccagttggcgtccgtcatgtccacttggttcataccagcgtaaggctgcccagcaggcaccttctcagcggaaccgttaggcatctggatgttcccgtagacgcccccgttgatgaggatctgcatggtccggccatactgcccaccacggatgttcacaagcccccgagtggtcacgttaggttgcccagcgccagtcagcgtaccgcccaactgagtgaccgtcttacggttggtcacgaaggtgtagtcagccacggtgatcagcctcaggtcatcccgagggttcgcacagttggcgtagccgttgtaaccacggaccagatactcattgccagctaagtcgtgaaccgtaaggccggacccgaagaacgacacgaagtattgctcggtggagtcccggttgatcatgtggaccagaggcttcacgcccagtgcgccagtgctgtacagacgcttgatgatcttggtcggtggtcgcttctgtagaccctgagtctccgaggaccaaccattgatttgcatggcaccttggttggagaaacgcaagatgtccggttgctgcgagatacctcctttgaggttcttgacgctttgcgaaacgagtcccataggccctccttagcggttggtgataccaccgacgaacgcatcgcctgtgatcatgttgaagccaccgaagtccagctcgtactcttggatggacgcccaagcctcagcctcttgttcctgcaaggagccctcgatctcaccagcaccgaagaaccgggtttggaatcgacgagaggacttagcgacgatgtacgagcggaaacactcgggcatctcagagagttgcttgaggcggatcaggtccacggtgattgggttttcaaagacatcagtcttcgcggtgcggtcgtaaacgaagccaccacggttgatgtacagggtgccgcctgaggtggtcatgcgcaggtagtcaggcaggtactcgatgagcttcgagaaggcgtccgggagaaggatcgcgccctcctcaatgttgaacgtccatcccttcgcttggatctcacggttgaccttggcgagaatgcgacggcagttcgctacgtcagcgttagggtcaccttcgagggaacttacaggggactcaccgatggcagcgagcatgtcattgacagcatcgagttcgtcatcagagtcgaggaccgattcataggccatgttgatctcctttcgttgaatgaaaaaaaaccccaaggagcccggttaggagccccaaggggttagttggctttaggccggggtgaagaccagcgcaccagcagcctcaggacgcaggccaccgtgacccatcgcgtacttgccgatgatctggtcagcttggtactcaggacgacgagcgcgttccagcgccatgtctttcagcttcacggtgccgacagccgaacggtgaaccagcaagccgatcacgttgttctgagctaccttgacatcgccagcagcagtggccgggaaggcgtgcttctggttagtgccgaggtcgtcatcaccagcaccgccagcgaccagatgtgggacttcgataacttcccagcccatcacgttgcggatgttgccggtctctgggtcgatcagtgccgagtagttggcagcgttcggcatcagagcggacaggatcgcgctgtagtcgtcaggggaagtgaagaagcgacggtcgccagcagggacgtagttcttggtgaagcggccacgggccagagtcagacctttcaggatcgctttaccacgagcctcaacgtcaacgaggtcagcagcagcaccgatgttcagaacaacggcagtgcccagaccagcgatgttctcgttggtagcggcaggcaggttgcacaggttcgccatctcggccagtacagcaccgtcagcggccagagccagagcttcgcccagttgtgccgagtattcagcacggacatcgtagtggttcatcgcgtcttcgatgtcgtagatcagaacgtccgaggtcaacagaccgtcgatctggatcactttctcggagtgcttgatgtctttacgcttgtcgtccaggttctcaccagcagcgaggtagtaacctttggtacgacccataacagggaacgaagcggacttaccattctggatggtacgaaccatatgcttgtccatggtcacggagcgacggacgaaagccgtcaggacttcgccaccgaacagcttaaggaagttcgccagtttgtcagcagggttctgacctttaccttggttcgcgccgagttgttgaccgccattcatgttcgccatgtattagttctcctttgtgaaattcttaagggcgcaagagatcctccgaagggaatcggataggtatctctcgcaatagtgagggtttattaattaccagttggtgcgcagcactcgggcttcgacttgggcacgataagatgggtcggtagcgtaacgggagtctcccatcgcctttaccatctcggcctgagacgcatagccttgtggaccctgaggggcctgtttaggaccacttgcaggggcgcgcttagtgacgctacgttccggtgtcttgccgaacttcttggtgcggctcgccatgcccagattgatcagcgtcttgatggacgcaaggtcttggttctggatggctcgctccaatgcttcaacagcatcaggagagttggccgtcatgtgagccacgatggctttgaacttctcgggaccgccagcgtattgctggatctgggccacataggtttgagccagtgcttcttgaccgctgataaacgacttcacgaagccacggctgtagccaaccttctccagcgcctttaaggacgcctcagagagtttgttgtcagcttcatactcggcctcgatctggtcagcgacctcttgtggcaggcccgctttgatcgcttgagcgcgcatctgagtgaagccatcagcgtactcatcgacggcctcagaggcttcgatcaggtcagcatcaggttcgcccagaggaacgaactcatcggagtcagcaccttcgtcagtgccctcctcgttcgtcaattccagctcttgagagttgtcctcgccggtatccagttgcagctcgttggagccttcttcggcgtcctcgtagtgcatctcgatggagtcatcgccatcacgaacagacacgggcattgccagcatcgcttgctcatgctcggtgatgttggtagtggtcatcacagcgctattcacgccgaagtgtgcatagacgtcagcttgggattcgttgctcattgggtctcctttagaaaatggagagacacacgcctcgggcactatccgaggtttcccagatgtacttgcttggcagaacgtgtgtctcgcaatagtgagggtttattaaatcggggccgcttcgatgcccgtagtttccatagcgccttggatggcctctggacttgcggtcgcttgttgagcgagaccctgaccgatgccagcagcagcgttgaggccaccttgcttgagcatctcttgggattggagctgagccttctcggcctcagtgagcagcagaccggacgtgtcgatgcctatagcgttcgccagtctcaacttgatgttgctcatgttgaggtctggatcagcctgtagctgactcacgttagccattgcgctcaagaactgattgagcttgtccaagtcctgaccacgacccagtgcctcgacaccagtgctgacagtcggctcaacggcctccttcggcatgtctgggatctgcgaggttgcctgtagttggttcaacaggatgcggacgattgggagttggagttcctgagagagaatcgaatagacgcccccaagggtgtcctcaagttcactcgccacatagcggatctcctcggcagtcacacgttcgcccttgcgttgtaccgcagagttcaacatgaagacgtaggagaggcgttgctcaatggcatcagcgacagacttagcgactgtgaagtcagcggtcttctccaactggaggaactcgatgtcggacttcttaccggcaacaaagtcaccagtctgagccttcaccaaacgacgaacctgagtgacaccgttagggttcaccagtccgatcaccttcgaggcgaccatcgagaacttgatcatggcctcatggagagactcaagggagttcaggtcaccgaggtattcctcgacatgagagcggccataatgctcgccatcacgtttggtccagcgcacagcgatccacgggcaggcatccagaggatactgaccttcggacccatcgacttcgacaccatccacttcctgataagaagcgaactcaccagactcatcgtccagataaacatgggtgtagacctcgatctcttggtcgggcttgcgctcgccatcagcgccaagagagttgcgaacgtcctcagggagagccgcaaaggcgaccttatccacggtgacgatctgtaagacgttcccgaaggcatcacgctggaccacatggttgtggagcgtgtagagcttcatcgggttgtacgcagacgacgatgcgtctggtggtggcaggtagatcagagcggaccctgcaagggccaactgacggatcagctcaaagagcgtcacacggtacgagttggcttccatgtaggacatcaggattcgctcaaccatgcccaagccttgttccacgacagccagttgcgaagggtcggagaccagttgcttcgcttgccactcggacaccttgagcttcatccagctttgcagcgggaatagagccagcatgaccttggcagacaggttgttgagcccacgagcgcccactgcttgccacggagtggagtagtcagtagaggcgttgtcggagtctttagggaacagcgaggggatggtgaccttcgcgcagttttcagcacgggtctcgtagggaactcggtcgtttttcagccgttcgtaaacagcctttgcgccctcctcagcgagcccggtgcgagttgtagtcgccacgggtcacctccttggttagatgttgatgccagtaccagcggaacgagccacgctcagaccacgtttaccacgcgcacgggcagccttcttggcagcctcggtgtcagcatcatcggagccctcagtggtatccttcggggcctcaacgacagccgctgagacaggcgcaggggcagccacaggggtcggtgcggcaggtgcctcgactacctgagcaggcgcatcgttaccgccagttgcttccttgatcacgccagccgggtcagcgactttaacgacagccttggtgaccttcttgacgaccttcttaattttcttgcccatggatgttctccttcagttgtttgtaattgatctcgtagcgacccacgcctaagcgcttcgtgtacgccacggtcttgtagccagcattggaggccagcctaacgattgcccgaaggatcattcgacccacggggccacggtggtccgggtgaacccagtgccattgcgttccgagacactcacctacatggtcatcctcatcattgacgaccacagcgaaccccacgagcttcccttgagggtctctcacggtgatctctatgcgttcgtcaagttcttcggttgaccggcagatgcgctcgtagcattcgactctggacccgccccacgtcagctcagtgagttcctcaaggatgtcgctcagcacctcacggaagcaggccgggtgaccttccttctggacatgcgcagccaggttcacttagtgaccttcttgagagccttcttgatggatgcagcaggcttggacttcttgatggtcccggtgcctgtatcagcagcgacagcatcagacgaaccatcgccagtgtcctttgtggaaacatcggacttcttgaccttgagaccatcgagaccctcatcgctggaggtgtcatcgtcctcggttgagccgaagtccacgcctttaggttcctcaatgagaaccggctcaggcgctttcacagcatcagggttggtctttggggtcttgaccttggatttaaaacacatggtcattcctccttgtttagttgagcctcctgcatcagctccacgatctcagtcgccccatggcatccgtcaatgaagcccatgatgtactgctcggagaaccccgctttgcggagatcatcgacagcaccagtggagatcagataggaagcgttgagacggacgttgagatagtcggcagatgcgggagagatgtcagggatgtcatccgggttttggatgtagtgttggatctgctttagcaataggactccttaagggaacactgggctccctctcgcaatagtgagggtaaattagggacgccagaggatgggcttcatggtctccatatcgaagtccgaagcgcggcagatgcgagccacttgggcttggaccaccagctcctcctcagtcattccctgcttggcagcgagtgacaccatgcagtcccagagggactcgccatcaggctcacgggaagtccagaacgggacctcctcgcctttacgtttgccggacttcatgaccttcacgtcttggaagtagaacttcggagactggagccaatccatcaggccaccatcgaactcgccaccgactcccggcacgccaccataaccatccgtggtgtcgcccttgagggtctgatagaagtggtgcaggtccgaggttgcctcatcgttcttgatgagttcctgctcggtcagccagaagaagtatcccggcaccgtgttgaagtctttgtcacagctcacgccgatcacacggtcacacttaacgatgctcgggtcagtcatcaggacgccacaaacatcgtcaccttcgacaccgtgccacttgagggacatgtcaccgtagtgcgccatgatctcatcgcagaacttgcggtagcccacaggcttacgcttacccttacggttggccttataggtctcaaggacatccttacgccagttgtcgtcaccgctcaggatgcagatgtcaacaaactcgtacttgtcctcagtgagcttgaacttgcgcttgagttgtgcggcgatgttcgccttgatggtcttgatggtgccgaacagaatgtcacgggctttcttgtgatcgcagaacagggtccatacgtcttcgccccagtcctgctcctcctcagcagcggacatcgctgagaagatgaggtagtccatatcatgggcgaggcccactttcagtttactcaaacggcacctccatattgtgcgaggaagtcttggccggaagtggtcaaggtccagagacccatgttcttaccggcagttgataggcacgagatgtggcctcgggatgaagcctcgttgaccagcgcaatgcgggaacgaacgaagtcgctttgatacgacctcgcttgctttttgatttcccagagaacctttaggtactcattcataccgtctcagtccaacgaggaccgggctcacggatgccagtgcgcttgttgtcgcagccagcgttagtgttccgctcggccagcacgcagttggtctcaatgcagccctgacaggaacgcttaggtggggcctcataggtcaccttgatgcagcccagtcgggcggtcgattcgttgccggtgatttcctcgaccagttccttgcggatcagctcacggatgccagcacggtagatcagctccatcacttgctcagtggtacggtcaccacggaacagctcagcgcggaacttggtctcacccttgagcttgtcgatctcctcagcggggatcttacgggcctcctcacgggtttcgtcgaaggctttcagggtctcggtctttaccacgatggtcatcgggaaggacacgttcagtttcagagtcatgctcataaggatctccttagtgacactcgcgccacgttgggccgatcttggaatcggtagccagtgggcagcggaatttgaatgattcgcctaccagtcggatggcctcgttggagacctttgcgaccagctcagcgatttcttggttgcggcaggcaatctggagttcgtcgtgaacccatgccatgaagcagaagtcaccggggttgccatcgtcgtcgtaccagccatgaacaaggccatgctcctcgacgagaatgcgttccacctcaacaacccacttcttgcacacaagcgcaccagcggactggagcagcgagttgagcgcggagtgaggggagcggacatggatctttcggccatcgagacctttgatccaacggcgcttccatttgatgtcgtacttcttggtgacgttgttgtacttctgctcggagatcagttgctcctcaagggctcccctcaggccagagatggccggggtgttctccatgaacgccttcttgagtgccttaccttccttcttgccaccaccaacgaacgacccaacgagaccatcaccagcgccatagaggaacgcatagatgaacgtcttcgcggtgtcccggtaggcgtcatgttcatggttctctttgtcacggattaggccaggaggagcgatgccagcagcgagcgcatttacccagtggatgtcaccgttcaacacggtctcggcatacgagccttcgtcgaatggcgcaccgaagtgacccagacagcgcagctcaaggccagaggcgtcagtccctaactggacggcgttctcccagcccttcttgagcttcctcgcaaagaccgccccaaagagcgcacggcacgcaggtccgtacttcttcttggcgctgggcacttggcccatgttcgggtggctatgggtcgcacggcctgttacagccccgttggggttcactgagccatggatgcagccatcctcacggacgtatcgcagccacgctttgtcgccctcagagagcatcccaatgaccttggtgacctccatgaactcacgcacaaggttgatgcacgcttgcttcttagggtcagccacacggacgaactcaagggtctcatcgtccatcttggcagcgcccgtgttggtcagctcggtcggaacccagccagcatcacggaggactttctcaaggtgcgcccgagatccggggttgaacgtgaccagttcgattggcgtgtaagggcagccctcgaaggtctctcgggtgtccttcttgccgctcttgaggaacacgccaccgatcttgggatagaccaccttcggcatgacacggccatcagaccagtagtcgattggtgcaccagtcttcgggttgaggaactgcgacttaccacctttcggagaccaccacgacccgaaggtctggatgagttccacgaggagatcgctacgacgaccagccagttcgcaatagagcttctcagctccctcgatgtcgaaggggaagccattgcgttccatctgggccagcgaccacgcagccgcatgttccaatcggatggcctcaatggcctcaccttgatcgttgaagtagtgcaggtcggagatgatcttgcggaacaacttcgaggtaacccgaacgtcctgctcacagtagtcctccatggactcggagcattccagccactccataccgtcaacgtagacgccaccatcgttctcaagctggaccttgaagtcgtgcttgtattcacccttcatctcgcccagacgatagccccacgcctcaagggagtgagagccaaacatcttgccgggaaggatgcccgaacgcatgagaccagagtcacgatcaccaacgttggagtaaaccagacgggtcatcacgagggtgtccatcacgcgcttccttgggatgttcaaacgcttaccgaagtagagacgcttgagcttgtcgaggaccgggatgtcgtacttgatgaagttgtgcccaacgatcataccgtcaggcttggcagcttcggcctcaagggcagcgatgtactccttgaaggtggactcgttgtaccgaacatattgcccggtgaaatagtcctgaatggtggcgcagtggaaccgagtgacggactcatagagcccgttcgtttcgatgtcagagatgagcatgaggccctccttagttggagaaggcgacagcgctcaaaggcagccatacgacttctgggcgatacgggcgcacgttgaagtggaacagcacggcatagccggtgtactcctcggagcggtgatagcggatctcgatggcgcggaacaccttgccagcgaagtgaggaccaaaggcgaatgacgccagttggctattggccgggatcttggcgcattgaacacggaagtccttgccgaccattggtgcaacgaggtgccagttcggaccccttgggtcgtccttaatgcgggccttgatgtcagcgtcaaccttctcagcgatcatcttgttgagcgcctcaaggattgggtccatcgggtttactggggcttcccaatgtgggtgatgcccagccttctcgatgtacgagtagcccagcttttcgagtacctcagcggcctgctcaccacgtttgatgaacttgcgaacgtcagaaccattcatgtgtattcccccctgtagcattgatgtgtgaactcactaaaaggcccctcaaagagaggcccttggatcagctcacgcgcttgatgtcttcgtgtttccacttggcttgcacacgttgatcgacggtggtttgcaaggcgttttgagcagccgtgatggcagccttcaaggacgcttcacgagccaccaaacgagcgtgacgcttctcttgaatgcggccagccagagtgatcaggaaagttacgatgtcgaagttcttcatggtttggttctcctttaaaagtcgggttcttgctggtctgcccatgcagcatcagcggcgtcagttgcatcttggtcaggtcgccagccctcaggcttcgctaccaatcgaccagtccgcttgtcgtattccatgtagccagccacgcccgtctcgcccgtgaatcgacacttgaggagtcggaacaggatgaggttagggttggcaccttgttggtttcgctctacagcgatgatggtgtcgctcagttggcgcagaccaccggacccacgcaggtcggtagcggtgacaggtcggccttcctcatgaggtttgcctttgtccgggttcttcaagtgacagataacgaagacgacaacgttcttggtcttggcgaagctcttgagcttggtcatgagccggtcgatcatcttgcgttcatcgttctcaccgtccatcgcagagaccacgattgagatgtggtccagtacgatcaccttgcaaccgttgacttcgaccatgtacgccagtcgtgccaataggcgatcctcagcggactcagcgaaggcgtcgtagaggtgcagcttgtcgctctcgaagatctcatcgaacgccttgtcgaacatctcctcggtggtctcatcggggttctgacgaactcgtgaccccatgtgaagccctacgatgtcctgtacggtttcctcaacggcctcctccagcatcgccacgcctacgggaatcccgcagtcattgaacaggttgtaagtgttctggcgaacgaaggtggacttgcctgagccggacccagaggtgaccagaacgacctcaccttctcggatgtccttggtcatcttgcggagttcgtaaggagccacgagtggataactcgggaccgctttcttctccttgatgcgggccttgagggacttcgcagagaccactccatccggtacgaatggggcagcgttccacatggcgtccatcacagctttggcctgggagttctggaggcactcgttcgggtctttgaaaggcaggactgcgatcttgaccttgcccggtgggagaacctcagcggcttcccttgaggcaatccgtccgggctcatccatgtcgaacattaggatgatctcgtcgaactgatcgaagtaggcgtagttggccgcacaggtcgccttggcagccttcgagccatgcccaatggacacgaccggatacttaccaccttggatctgggccactgtcaggcagtcgatctcaccctcggtgacgacgatcttgcgaccaccgttccacaggtgccgaccgaacagagcgtccttgtcgtgcttgcccttggtgaagaagtccttgttggcttgacggcacttctgcgacttgaggttgccctcggtgtcgtagtagttggctatctgtaccgggacttccttgccctcatgaggcgagaacgccttgccgatccagtaaccatagaggcggcagattggctcctgtaggaacctcttagggagcgccgagaagtagcctccagcctcgcccatcgagagcgtgccgtcagctttgagcctcggtgtgaactccccacgctccttcccatcgggtgccttgtaggcagtctcagggggacacgcaaagcagtattggtgaccatcagagaacagcgagtttgcatccgacgacccacattcctcacacgggatatgcgcaaggaaaacgctttcttcgcgttcctcatgcgacgacatcggccacctcgatctcatcgacgtaccgaccatcacgcatcggtgccttgtgaatcaggtccagccacttggcttccatcttttcagcacgggagccacgagcgtcctctcgcagttgaaccagattggtccaagcgtgagcgcccatgaagcgaatggttgccccttcgatgcccctttggatgcccgagatggcgaactgattgaggttgtagtcgaacttctggatggcctcggtgacacactcgacctcgtaaagaatcacgtcgatctcgcagccttcgattttccagacaccttgcagccgatcagagtcggagccggtgtggtacttggggaacttgtggtaggtgtagccaccttcatcgagcgctctggaaacagtctccgggtcggtgcccgcgcaaatgatgtcgatgtctttaggctcaaccgagaagaacaggtcacgggcacagccaccagcgataatcgcgccgatgccacggtcaatgagatgctcacaaaggtcgaacccaccttgcagtaaggaacgattcataatgacctcctaaagtcaacgtttaaaaacaacaaagccccaccaaccgaagtcagtgaggccgtgtcgcaacagtgagggtttattaaatcccttgagttttcagccactcggccacgtcgaaggacgggcaggctttacccgagtcgaggtcgcggtgacccacgatcttggcttgcggataggtgcgcttgtgagcgatcagcagcagcttgagcgagttgaattgctcaggcgtgaagttgttctctggggcgcccttggcgttgatcccaccaacgaggcagatgcccagcgaggtggagttgtagcccttggcgtgtgacccaatgacgtcatgagggcgaccatcctcgacagtgccgttacggcgaatgacgaagtgatagccaacgtccagccagccttgttgaacatgccactggcggatctctcgaacgccgatgtccatggtcggtttggttgccgcgcaatggaccacgagcagggtcgtacttgggcgtttcttgaaagcagcctttggcatcatttacctcctttcggatggagtatccccgctgggatctccttacgtttctcctgtagccatgctttaggaatgagtttgtctgcgaacatgatcccgtgcttcgtgcagaagtcggcgtagctcgttggggagcccttatagatcttgctcttggagttcgagaagaccagacggatgtcaaggtcagggtattgctcacggatcagcagatgctttttccggtcgtccacttcccatatccctttggtctccacgatgatcccgttacgcagaacgaagtcaggtgtgtacttggcctcacgggccggaacgacgtacttaatgtggtactgctcgaagtcgaaagggactccgagcttgtccatgtgagccgcgttgcggtcttcaaggccggatcgaaaagcgcctgtacgagcgcccttcgggccagcgtagccagccatcagaagtccgaggcagcgtcaggaatgacctcgccagcatggccttggtcttcgtgatcgtcccagctttcttcacgctctggagcgacgtagccttcttcggtttcatcagcccagtcgtcattgccagcagcgtactcgaccagtttgatcagcatcacgctatccagttgcagcttgaccgaggcaccgacaacggcaccgaaggtgtaggcgaacatggagaagcgaaccttcaactcggaaccaccagagatcgcaggaacagcgtcgatgcgcttgcccttggcgtccacgaccttcaaggtcagcggcttggtctctttggtttccttgtcttggtacgaggcgtagctggagaacttgaacgtcacggtgccatcgtcgttctcgaagaacggcaggtcgccctcatagggttccagcagtttcttgccacgggccagcttggcggtcagcgatgcgcggttcttctcgaagtcctcgcagattgccgcgtagctttgttcttgcatccgaacgatgcggtcgatgattggctgggcatcagcacggctcacggtcaggttgaccttatagacgccacgagggttgccgaagcctttctctgggttgccgtagtccggcttttggatcgagcagtaaggttcagctacgcctttcggagtaaagaagaactgcttggtggattttgccatcgggattatctcctatgaaagtgggaaggtaggtgtctcgcaacagtgagggtttattcagtacgagagggattcacgctcggtgaacagggtctgcttgaaggtctcaatgaccgggatcagcgtcaccttggtcatcgcatggacgacctcacggaagttgttcttgaggaactccttggagaaccgccagcagccgtgtttgaagtggtgcagctccttgccttccagctcagcggtcacgatggcgcgctcaatgagcagcccttcgaccaactgacgttgatgggcgtcaaggatgtggatgtagaccacgccagccatccccgcgtgcttggtcacggtgaagttctggatgtggaggaagccgtcaggcatcgagcgggtgttgccttgggccaggttcattgagtgacctccgggcggatgcgccgaacgttgtcttcaccgtactcaaggtcagcagcttcgagcgcttcctcaatggtgcggccatacattggcacctcttggacctccttgcggtactccacggtgacgaggaacttcttcattttctggtcttgcttaggcatgagtaattactccttgagttctgagttggtcgatcatctccgaggcgtggccccacttgttcaccacaacggcgtccatttggaagtcacgcagttcaatgtcagtagcgtggagcggctggtcatccacagcagggatcgcccagtctcgggagagacgaacgaggtgcgcttggcggatgctcagtgctgcatattcgttggcttgacgcatgtcagtgacgaccacgagggcatccttgggagccttcttgatctccttgagaccctccagcagccacacgtccgggttctgcttgtagttgcgacgaaagccggtgccgtattgctggaggtgccagcgaggtgtccttgggatctcaatgtcgaggatctggggctcattcagcagccagtccttgtactcgctctcagggatcgcctcgattgccaactcctcgaactgagcgtccttgaagtcggtgtgcatgtggctctccataacgatgcgttggcattcgtcgagggccagcatgtggctgcattgcttcttgaggacatccccaaaggcgacccggtagacccggtagccctcgatcatcagaagctcgcacagggtgtctttgccgctacgaccacgctcagaagtcagggcgatgatgtcagtcattgacgatctccttgatcttggtccagaggttcttgaagaacgtcttggtgcgctgccagaagtcggcctttggcgctggtggtttaggtggacggatgttgaaccgggcgcagttgcgttgacggtcgatgttcgattggtgcagacggtaggcgaacgaacggtctttaacgggcatcgtttggatctcctttcggtggttggttgggtgtctcgcaacagtgagggtttattaatcctcgtcgtcgtagaggcgctccacgggagtccggtcaggctcgaagccagctataaggatggcgaaggtgatcacaacgaaaactatcatgaggaacttgatcatagatttctcctattcagacaggcacaaaaaagccccaccgaccgaagtcgatgaggctcgtttagttactctttgatgagtggatcgctgataccacggaactcgtcgaagctcgggtgacgcatcgacccatcagggtagcgttccatgcaggtcactcggaccatgtggtggtggtacgggttctcagcgtcaaccaatgagctgcccatcccgtagatgatcgactcgatgtcctcaacgtcataaccgttgtggtccatcactttcttggtgaactcctccatctgggccttactgatcttgcaagcgttgaccacatggccggactcaagttgaacctcgaagccgatcaccttgccctcgttggctttacccttcgagccccagaccagaccaaccaccttgccgtcctcgttgttgctcggcaccttcttccaccagccgttgcacttcgagcggcgatagaagcccatcggatctttgaccaccagaccctcctccttgcgctcacgcaccgaggtgtagagctggaccagcgagagtggcggttggagtttgacggtgatctcgttgccctcctcgtcgaagccttcacgctcaaccactggcatggtctccactgagaagacctcgtaggactcagcgacgatccattggatctctgggaagtattccttgagcttggctacctgatactcaacgtggatcttacggacgcactggaagacctcgtattcctcaccgctcagcacaacgtccattggtacgatgtcgaagacgtagacccggatgcggctcagtgggatcgactcctctttacggcgcagggtgcccgaggtggtcttacagggaacctcacggtcatccatgtcggtcaggaccagctcagcgtccaacatgaacccttgagggaacatcccctcgcctttgttcgcgttgaagaagtcagcccagcgagggtcggtgtccagaggaccatgagatggcccgaaggccgggaagcgcttgccctcacgggacaaccactcgacttcccaaccgtggtcatgcttggtctcgatcaggttcacgcacaggttcaaacgaacgccgtccttcttgacatcagcgatcaggtaggactcatccagaacagcctcaacagccttctcgttgtagtcggttgggcggaatggcttggtgttcaggataacggcttcgactttggacatggggttccccttagttggattcggtggtggtggttttaggcttacgaggagcgcgggttttcttcaccggctcagtcacaggttcagcctgggcctcatcgacgatcatcacgtcagccttgacgccttgcagttggctcgaagggaccgcgctcacgtcagtcacctcagcgggcttcttgaggatgttcatcagggtcttgaagtgcgcctcaacggagcggatggtcacagcctcggcaccgacccgaagggcttcgatgcgagtctcaaggtcaccactgagaaagcggttgtccatcagctcttgaacgtcatagccagtcttggcggtggtcgtaacgtcaccgatggtggtggaggtttcgatcaggatcaggtcgtcaactttggacgaggtggcggtaacgataacttgcattgggatctcctaaggttgggaattagtaggcagcgttgccggtgcagattggggtccactctacgcgaccaccacggacgggcttgttgcgcttgcccttcttggtgcggatggcttccatctcggagtcatcacgcagggtacgtttggtggtcttaacgaagttctgagcggcgttcataattggtttccttatgcgaaggcgaagtcggatttgagtatgtcgcggatgttgagcgttcccatctttggaagctcaggcatcttgtccagttggctctcgtgtagttgctccatgaattgctcacggaagtcagccagcacgttgttgttctcgtaggtttcgaccatggtctctcggactgcccggaacatcgcgccagctttggcagggatggtgccgaacgagtcgtggatcagggcgaagaatcgaatcccgtggttgtcgtaaccgtgtacgaccgtcttgcgaaggtgtgagccgtcttggctgtgaacaaagttcggagagatacccgactcttgcttccttgcgttgatcttgctggacccgttgtcgcgcatcatcacggtggcttggatgcgaacgtccccgaggaacatgaggtcgattcggcgcgttgggttgatcgtgtattgctgccataccgggaacccatcaggggtcgtccagtagactggcatggcaggcttgaggatctctttggtcttcttgcacttgacctcagaggccagcagcttggcggccttctgtagccagttcattgcttccacagcagcgaccacaacaacactcaccgagtcccagattttgccagccatgtagcggctcgcttcaccggggcttgtgaacatgtggccctcatcgttgtcgatggccttctttacgatgtcctctcggacttgatcagcgaacccgtaggctttcgacccgtaggccagcgtcattacagaccgcttggtgaccttacgagacatcccgtaagtgagccacgcaatggcgagggtcttagtgccgagacgtttaacatcgcggatctctccagtgacctcatcgacgagagtttcgatccagtcgtccgtcccgtacttgaggtcatattgcagagcgatctcgacttcatcagagacgatcttgtagatgtcttgaacggagtccgaagggatgaggttgacagcacgcccaccacgttcatctcgaagcatcgcggaaaagtgctggatgccagaacaggaaccatcgaacgcaaggggtagggcactgacgtgtgcagcgccattagctttaacgccagcccattcaaagcagaaagcgaggaagcagaacggggagtccatggacatccattcggtgacgttgaggggatcgttggcaatcgccaagataagttcttcatggtctcggacccattgtttacgttcaggaaagggcaccttatcgacgcccgcagtgttggccccgtgaatcatgagccactcgattccctcctcgcctacaggttccccatgggcagcctgcaagatccctttggtcatgtcgttagactgagggttgaaggcagggaccgcgtagacccggccacgccaatcgaggttgtacgggaagtagatcgcatcgtactcagcaaacttgttggcttgctccagtccgaactcgtaggccaatcgccgggatacccttgcggcgtccttacggtagaccccagcggcctccttcttccacgccttgagagcgtctgggttggtgtcgatgtcgtggggtttcagtggcagctcttggcgttccgttgtagggaactccttgatctgtacgttcttccattccatcaccgcattggcaacctcaaggacgcgcttattgactgcccaagcggttgactgtgcgatgttgactgcccggtaaaccgcaggcatctcgacatcccggtagcgctctcgggcttgcttgccgttgagtcggatgaaggtcagaggcttgcgacccttggcccagtaaccgccaccttgcagacccttccacggtttaggcggaacgatgcagggttggtactgaggcgtgataccggccagtgcgaaggcccggttctggatcttgtcagcccattcatccttgaggaacacatactcgccatcgttcttcttgtccccagcgtgatcacggcgaacctcgatcagttgggtcgattcgatcaacagctccagcattcggatgcccatgtggaagcggacatctgagtcagcgacgttccagtcaacccatggttgggccagttcgcccttctgtagcatcgactcctcgacccgctccatgtacgccttcttgtaggtcataccgttgcgcttggcgagagccggggcgatggctcgcttgaagtgttcggcctcaaggactcggatgcggccaaagcgcgcttcgtcttcgagggctccaccgaccacgatgctcatctcggtcaccgttggggcaccattacggcgctgggcgatcatgttgagaacgtagcggatggtcacagcggccatcgtgtccgggttcatttgctgtgcagcggcgaagctcacatgtttacggccacgacccttgttggcttggtggtcgatccatgcggtgatcgcagcggacatcttagggaccagagtgcccagcagcggctgagcggcgatgttgttggagaactcaccgcgctccatctggcgctccatctggcgatgaaagcgttcctctccaagcgtgtacgcttcgtgttccaagcgcagttgctcagcggccagttcggggccgtagatgctggagagttgattgaaggcgaatgaggatgttgcgatgtcagcgaagtcgtgacgctcggggatcattctttaagatgctctatgagatatagttgtcttatagaattgctctataaggtttatctcagagggatctttaagatgtctttaaggtgatcttttaggcaggaaccctctgaggtgtctcgcaacagtgagggtttattaatccagccttacttaaccacctcgatccggccatgaacgtcggccatcttgtagacaaatgtcttgagttcgaggtcatcgttccacttcgtgatagcggagtaatacttgctgatctggtctcgcagttcggccacttcggagtcctcaaggagaccctcaggcttgaccgcatcaccatgggtggtctcaatgacatcgacccattcctctttgcgccaccagagcatcccggtgactcgcagctcttgccgcttgagggtcacagcaggccggtaggtgcgctctaagcgctggtgccgctccagcttccacttggcatcgcattgaggctcattgagcagctcagggcttcgtgaccactgcttgatcgtcagtaggtcatcagtgatggcaactcccaggctgacaacgtgacgaccacaaggcccaaggcccagctcaaaggtcagctctttagccttgacgagcccgtaggtgttcggatcgacccacgaggcgcggaacttgatgagcttggcgcgctgggtgtagtcgctgggtggcgaaggaatcattgaggggcgcttagagaagccacgcatctcagaaccctccccgatagcagcgagtgaagtccccacggtcgctgtagcgcaggccggggcacaacataccgcccaccacttggcgagcttccatagcactcaggaacgcctcagtgaagtccttgcggcgtccgtaccagtagccaaaggcgtccttcccggtgcggacggtgttctttgaggtgatgatttgttggtcaatgagccccggctttcgaggctggtaattcgtgtgcatcacttaacttcactccagtggaccagtagttgtcggcagccttcggtgacaggcaggccataatgcagggtcgttttacccttgaagaacatgccccagccgggttcattctgagggaccatcacgtcagggaagaaaggcccttgagcagccatcgtgccgccccctacatggtcatcgttgagcgccaccaccagagtgacgtcagagtcccggtcggtgtgccagtggcctcgtggagtctctgagggctcatagcgggcagcctgtacgctggtcaggttctcaggctcaaggttgaacagcaccttggcgtaggcgatcccagcgtcagcccagaaggaccggaagacctcgaacagcaccttgtgttcatcctgcaaggtcacctcagggatctgcgcctcaaggggctcctcaaggttgggctcgaagacgaacttgcccatctcgtgcttgatgtcgcggcagtagcccggatgcaggtaggcgaccgagtagatccccggtgcatggcagaccacgcaatcgtcaaggaacttttgccacgaggaggactcagagaacttgctcgggttgatcccgccgttgtcctcagcgtatgcggccatctccttgagggtctcaagatgctcacgcagaaggggatggtacttgtcaaccgatgcgatacccgtggtggccttagtgagaacggtactcatccgaacactcccagtgcgacgagtccatgcccagcaccaccaccaaccgcaagcgcagtcaagtacccaagggtctctttaagtgctgatttccaacgattttttgcaggtttgggcttgctttcagcttccagttctgcatcacgacgacgagcggtcaacaatggatgctcagaacgtgtgtataattcgctcaacaaccccgagaaggctcgctcatgctcctcggaccagacgaagcaggcttgcaagatcaggctgccaacgtcttgaccagaaccagcaaggaactggaaggtgtagcccccgaagtcgtcgggttttacgtccacacggagccagcgttgcccgtgccggttctccacatagtgggcgtaaccatcagagagagcgccacgcatagcagcgatgagacgttcagcaaatgcagccgaggtgaagttagtacggttgtagcgttgcataattcaaagacctaagaagtgcggtaaatggagcggtacagaatgcccacctttgcgctgttatcgacgcgaaggcaggctcttattgaccatcgtagagaggtacttatttgcccggtggcaacatgccctcgattggcttgcccgattgttgctgaatcagcaggtccagcttgaggcgttccagtgcagcggcctcatcgcgttgcttctgctcgtcttcaaggcgttgcttttcggccttctcctcgttgctggagttgttccaccagttcgccagagaggtgcccgcaaaggagcccgctacggtactcatgaagccaccagagccaccgcccatggccgctggagccgattgatggaccacagtggtacggttgacggtgacgttctggacgacccgaggagcaggcttgtaggagctggtacgcggtgcgctgtaagagcgggatgagctggagctactcgaccgactacccgagaaacctcgtgcctcagcgtcattcgcatggatggccccgagggcgatcacggtagcgaacagagcgaacaggcagatgtttttggactggcgagcgattgcgtggatcatttggatctcctatgtggtttgcgttgagttgttcccaatgagccctcagcgaaggcccatcagtgaatcactcggcgtctatggtggcttcgtcgaaccatctggagaacatggactcgaacgatgtgatggcgctgtagtcggctatgacctcctcagcggagttcccatagaccagccagaacttgccgatgcgttggtaggtgccgtcatcagggcgaacccggtagaccaccacatggtcctcatcagtagccatgcaggcgtcaatgccaacttgcacggtgtaggtgtggttggtctcgaagtcctcgccgttgttgatgcggaagcagtagccagagccagtgatcgcagtgagcagcttacggaggactcggcgttccccaatgatgcgctcagcggtggccggatacttggccttgatttgctcgttggtcattttcattgcacttgctccagacgggagaggaagacgtagaactgacgacccggtgacagcgaggctgtagcggatggcttgtagcgcatcgcttgagcccactcatagagcgtgttggattgactggaggagagcgtgtgaggatcttgcccgaacttgatgccctccttcttgagttcctcaatgatcacccggtagagcatctggcggaaggtaggaacgctcatttcaggtactccccggactcaatgagcatccgagcggcttccttggtgatgcaggtgttctcactcggtgaccaatacatggtgcccttagggacatcgctgtaggcacactcggtgacggtgcgaccaaccatctgcttgatgtcgcattggtcccactggtgcagccttgaggactcattgaggtaatggtcaccaccgttgaggtaggcattgcccatgagtgcccattgcgacttgctaaagtgagccttgacgacacggagaacagcaggtgtgacgaactgagcgtagtagcgacgatgagccgcgctgccatcctgctcagggtattccgtggaggtcttgcggccatccatgtaccaatagcgggtcaggtagaccttatcgttgatcattacgatgtcagcggtgtgttgcttagccatggtgattgctcccaggttgttggtgtgacgttgagttgttcccatagagccctcaaggaaggccctacagtgaatcgctcaataacccgcccagcggcgtaactcgccgtagttcaggaagggccacggatgaaccttgccgttctcatagacccagatggcgaggtggccagcctcagtgcgataccacgatttaaaccagtcgtgttgcttggcccatgcaatgacagcctcgtcgatgtctgggcgtggcgtgttgtgactcatggtcactccttgtcagcgttgagttgttcgagcaggtcagccttagtgcgatgccacacggcctcaaggacacggcagcgagtcagcgttgagtcaacctcattgcgcagcttctcccacataggatgagcagcagagccctcaaagcgcccaaagatggccttagcggcttgatgctcagcctcagccttcacaatacgtgcatcgaggtcagccagctcagtgcgtatacgatcagtgcgtgtactcatggtgatgctccttgcttgtgtgttaagagatacagacgaaggctctccacgtcccgtgctaatgcttagatacacgagagccctcttgctgtatttcctttcactgctacgcaccgagggtctgagcaagccagttaagacgtcatcccgtctcagtgcgtagtgttgcagtccgagttgttaaagagcgtaagggtgcccgttaggccgtggttatcggccaattcgttgcccttcttgcgacccatgctggtgactttgacctcacccgacccaccctactcatgacatctgctcaggtagctcgttgcgtgtttcgttgttgatgtggcgtattctacagcgtgttgctatgttgtcaagcgtttgtttctgcccttgtgtcgctcatcgttcgtcacccttaagacccttggcacacgtatgatcgcaggtcagatgctactaagctaagcgaccaactcagagacacccgttaggccgtgtctcgttgttgatgtggcccattgtatagaactgagcatcgccgtcaacctgtttattcatccagtgtataggtcagcctgtaacaactcataggctacgcatcgcctctatataggcaactcaaggccatcctaaggagcagggtctacaggcaccttataggagccctaaggatggccctaaggagaggcgtcacatgatcaccctgggagtgacctaaggagcagcctaaggagcagcctaaggattgctgatacagatagggacagatggactactgtatgaatccccagtgttgacagctcaccctttaggccccatcatgtacctcaacgaaccacctaaggatcaccaccatgtagccaccattgagtcacctcatcgtatccctcagatgatcattgagatgccctatggggagcagagcccttgggatggctgagagaggccctatggggggattcgttggcgtttgtctatgagaggtgccctttcagatttttctatcagattcttaaaggacatcctaaggtatccaatgggttcatgcaagtgccatctatcggttatcctaaggaagaccctaagggcctatgaggactcctaagggctttcttaagctgaccaatgaggtagggtgtaaccataccgaaattggtcgtgtcggtcactctacgcagccaccagatgccacacatacgaggtcagagaccatgttcatgacatcactgccattgaggacacctaaggccaccagcaaggtgccgatgagcttgtaggtggtcttggagagagccaaccgcttgagtacgagcagcacggtggctttctctacgtccatggttgtggtctccttcttgataatgatcatagttgataaccatccttggtccagttcctttggtcggacctcatcctgaggaacccaaaggttagaggcaccaccttaagaaccttgctgagatcttgttaggaatctcttaggtatcttaaggtgggcctctcccaatagtgagggtaaataaacttcgtcgatcatgcttcgatcatgcagacttcctaccagcccatatagttggtcattgagccttcatcgtcgaacatgatgtccacggagtcactgattgcgatccttctgacgtcctcaaagcccatcagttggttctccatctgggcctccaagaactcagccatcagttccgactcgcccagcttggaatccttctccatggcctcagtgaagaactggacgccaatcgcaagggcatccaatcggtcatcatgggccagcgatccacgctcacgggtgatccgagagagctgatagagcaggctgtacttgatgtccgtggtcccgtcagcgttgagcgcagtccggtagtccttgtcgatgagggcctcgctgagaaccagcttatggctgcccagtacgggctccagaacgtcgcagatgcggagttccttctgacccttggacttgacctcagtgatcgcgcacggccatgtagcggtcagcacaggactgatcagcttgaggtacataccgtcaccgaagttgccctcgatcacgacctcattgaccttgtagatcttggcgaggttcgataaggcttggagggttgtgtcctcgtagccaccacggaagccaccagcgtccatcaggaagatgtagccgttgagctggtacaggactgcatagccagtctcatccttaccgcgccccgatgggtcgatcacaaggattttctgagcgtactgcgcagtggcctgacctacagcttcgtaacggtggaagcggtcacctttgagacccaccagaggaacgcccttgacctcgttgttggcgtttggcatccatgtcagggtggttggccctttcatcatgtcgaacgtccctacgatgaaatcacgcagcttgagagggtacttctcggcgtcactgaggttagggttgagcatgaactggagggcgaagccacctttcccgtaggagagttcacgttccctgagatctgtatcgtcgaagcgtacagggtcagtcggtgcccagaacagggaaccatcagctctcagctcagcctccagcatcggggccagccgtgggccataggagtcccaatccttctgatctttagggtatctcgcaggccagatggtagtgacgtagccacggccttccagctcacgatagagggtcatctcggtctgaggtgtgcccagatagatgatcgtaccgcccggtttcaggatcgcatcgaactccttcacaagttctcccagggcgtcacgcgcagactgggtgccagagttgttcggaacctcaacgtcatccgcaatgaggatgtccgcacgggaacctgtgagctggcctgtgatacctaccgacttcaccgagggcgagtggtcaggcttggcgagacccacgtcgaaggccagagcggagtctcgttgacccgtccgtggtttcagctcgtggaggaatggaagcagctcgatgatccgcttgatgaagatggagttggcgtctgcccgttccttggaagcggacacgatcatgaacttgaggtccgggttgccccacagcttccacacaacgaatgcgcaggtgatgaaggacttgccgatacctcggaatgcttgaaggatgaatcgacgttcgtcaccagagctgagcttcttggacatgtcgatctgacacttggttggtttgggtaggttgagggctctccacaggacaaaaagaaaggccacgaatgaccttttcattaacgctatgtcgtcgcccccattacggggtgcgctcatttagttcctccttgaatggtcttaatggaatcttgcaggcccttcacttgggcgtctgctcgttgggcttgttcgataagaaatcgaccatcgctttctcgtagctcggcgcgaccatcagcgaggggtctaccgtcagccgtgacgcacttgacggtggcatctgcgagggcgactgacaggctgataccattgctacgcagaccagcaatagtccgatcagcagatgccttactcgttgagagataggcttgccagttcttcgagacatcagcgagggctctttgggttgtttcacgttccacctccagttgacgggcagccgccagttgttcagtttgatgtttgagggtcagtgtgtcggtcgcgtcagagtgacctttggcatacgtcagacctaagcctgtgcaaaccaaaaggccccacatgacgaactctttaaggttcaacatgcagggcctcctttagtggcgaacgtccgaggcgtacagctcgtcgtcagttaactcagggatctcatcgagagccgaagcgagatcgcccagaagggactcatcaggttgcagcttggcgatggtgaacttgtggcgttccagcagcttgcccacagcgttgtagagctgaggcgttctacgctcaggatcacggaggtcagccaacatgttcttcgccatgtcagtgtccagcgcgaccagcaggcgcatcagtaagtcatcactcatttctcagcctccttgtctttgcggcgttcttctttaacggtcttgtaaaccacgattacagtcatcacgagggagtacaaaacggcggatgcgtagaaccactctgagggtgacaagcccagaaacaaccgggcagtcacgtcagttacagcggcacctacgactggagtcgcttgcacgaccccgttgttgaagtcgatggagatgcccattaggacacctcacggttgacgtagcagaacgtcatgtcataggtcgctttgtggtacgactcgatgtccttgatgcggccatagaggtacttggcgcgctctacacgctcaggtgcagcgaggcccaattggacctcagggatgatcttgtcgaactccacacgaagcgcagagacctcctccatgagcaggttccatgcctcgatctgcgattggtcaggaccggcatactcagggatgtccccagcgagaccccggtcgatgatctggaatagttcattgccatgcgcaacttcgtcgccacgcacagcggtgtactcgatgtagtcctcgatgtccgagaactttacgaggcagtaggctgcatccttgttagggcagcaccattggacattcttcacgtccacgatagatctgttagccattaatcctccttacgcatagcgcatgtatagggtcacggagtcaggggatgcgccgtcagcgttaaccaacttacccatccgaacgtagttaccggccaagttgtagccagcgaagtaagtgcca

SEQ ID NO: 8 - DNA, 41244 bp, unidentified
  misc_feature 1..11: note = bacteriophages nucleic acid sequence
  source 1..41244: mol_type = genomic DNA
atgagcgcaccccgtaatgggggcgacgacatagcgttaatgaaaaggtcattcgtggcctttctttttgtcctgtggagagccctcaacctacccaaaccaaccaagtgtcagatcgacatgtccaagaagctcagctctggtgacgaacgtcgattcatccttcaagcattccgaggcatcggcaagtccttcatcacctgcgcattcgttgtgtggaagctgtggggcaacccggacctaaagttcatgatcgtgtccgcttccaaggaacgggcagacgccaactccatcttcatcaagcggatcatcgagctgcttccattcctccacgagttgaaaccacggacgggtcaacgtgactccgctctggccttcgacgtgggtctcgccaagcctgaccactcgccatcggtgaagtcggtaggtatcacaggccagctcacaggttcccgtgcggacatcctcattgcggatgacgttgaggttccgaacaactcgggcacccagtctgcgcgtgacgccctgggagaacttgtgaaggagttcgatgcaatcctgaaaccgggcggtacgatcatctatctgggcacccctcagaccgagatgaccctctatcgtgagctggaaggccgtggctacgtcactaccatctggcctgcgagataccctaaggatcagaaggattgggactcctacggcccacggctggctcctatgctggaggctgagctgcgagctgatggttccctgttctgggcaccgactgaccctgtacgcttcgacgatacagatctcagagaacgtgaactctcctacgggaaaggtggcttcgccctccagttcatgctcaaccctaacctcagtgacgccgagaagtaccctctcaagctgcgtgatttcatcgtggggacgttcgacatgatgaagggtccaaccaccctgacatggatgccaaacaccaacaacgaggtcaaaggcgttcctctggtgggtctcaaaggtgaccgcttccaccgctacgaagctgtaggtcaggccactgcgcagtacgctcagaaaatccttgtgatcgacccatcggggcgcggtaaggatgagactggctatgcagtgctgtaccagttgaacggttacatcttcctgatggacgctggtggcttccgtggtggctacgaggacacaaccctccaagccctctcgaacctcgccaagatctacaaggtcaacgaggtcgtgatcgagggtaacttcggtgacggtatgtacctcaagctgatcagccctgtgctgaccgctacatggccgtgcgcgatcactgaggtcaagtccaagggtcagaaggaactccgcatctgcgacgttctggagcccgtactgggcagccataagctggttctcagcgaggccctcatcgacaaggactaccggactgcgctcaacgctgacgggaccacggacatcaagtacagcctgctctatcagctctctcggatcacccgtgagcgtggatcgctggcccatgatgaccgattggatgcccttgcgattggcgtccagttcttcactgaggccatggagaaggattccaaactgggcgagtcggaactgatggctgagttcttggaggcccagatggagaaccaactgatgggctttgaggacgtcagaaggatcgcaatcagtgactccgtggacatcatgttcgacgatgaaggctcaatgaccaactatatgggctggtaggaagtctgcatgatcgaagcatgatcgacgaagtttatttaccctcactattgggagaggcccaccctaagatacctaagagattcctaacaagatctcagcaaggttcttaaggtggtgcctctaacctttgggttcctcaggatgaggtccgaccaaaggaactggaccaaggatggttatcaactatgatcattatcaagaaggagaccacaaccatggacgtagagaaagccaccgtgctgctcgtactcaagcggttggctctctccaagaccacctacaagctcatcggcaccttgctggtggccttaggtgtcctcaatggcagtgatgtcatgaacatggtctctggcctcgtgtgtgtggcatctggtggctgcgtagagtgaccgacacgaccaatttcggtatggttacaccctacctcattggtcagcttaagaaagcccttaggtgtcctcataggcccttagggtcttccttaggataaccgatagatggcacttgcatgaacccattggataccttaggatgtcctttaagaatctgatagaaaaatctgaaagggcacctctcatagacaaacgcccacgaatccccccatagggcctctctcagccatcccaagggctctgctccccatagggcatctcaatgatcgtctgagggatacgttaggtacatcgttaggctatcacatggtgggctcctttgagatcccgttgaggtggccttaggatggaccttagggagcgtgatgtcaaccctgtggattcatacagtagtccgtctgtccctatctgtatcagcaatccttagggccatccttaggctactccttaggctactcccagggtgatcatgtgacgcctctccttagggccatccttagggctcctataaggtgcctgtagaccctgcccttaggatggccttgagttgcctatatagaggcgatgcgtagcctatgagttgttacaggctgacctatacactggatgaataaacaggttgacggcatcattcaagtctatacaatgggccacatcaacaacgagacacggcctaacgggtgtctctgagttggtcgcttagcttagtagcatctgacctgcgatcatacgtgtgccaagggtcttaagggtgacgaacgatgagcgacacaagggcagaaacaaacgcttgacaacatcgcaacacgctgtagaatacgcaacatcaacaacgaaacacgcaacgagctacctgagcagatgtcatgagtagggtgggtcgggtgaggtcaaagtcaccagcatgggtcgcaagaagggcaacgaattggccgataactacggcctaacgggcacccttacgctctttaacaactcggactgcaacactacgcactgagacggtcacggacccttagggcaaccatgagaggtctgtaggccctcggtgcgtagcagtgaaaggaaatacagcaagaaggctctcgtgtatctaagcattagcacgggacgttgagagccttcgtctgtatctcttaacacacacaagggcaacgcatcatgaaaatgaagcctgagcattacgcaatcctcaagggcgcctttgcggctgtcattctggccgagatggagcgcctcaagggtctaccggacatgcctcaaaccctgcaagaactcatcaagtggcaatgggaccagtacccaacgccaaccgatagacgcttgcactttgacttcttctggtgggtccgtaggcgctctcctgaggtgatccagatgatggacgcattctatcagtacgccaacgatgaccacctctatacggctctcaaggccgtccttaaggagctgcaaaatgagtctacgcactgacaagctgcgcactgaactcctcgaacttgaggagcgtatgaagctggccgataacgcccatcaagctgcaaggtccacctttgcacgctttgagggcgcctctgggtcggccttgtggttcaaactccgtgatgaggttgaccacacattgacacacactcgggtccttgaggccctctggcaccgcactaaagcggctctgctcgaacaacaaaacgctgacaaggagtaacaccatggctcgccaagtaacgcaagacgctgtaaacgcattcctcaatggtcgcactggtaagttcaacaacaccgtggtggagctgtcgccactcggtgaggtgctggtcatgaagctgcacggcaacgctattgcacggcgtgacgtgggtcctcttggcgcctttgagatctgtgatggtggctggacaagtaacactaccaaagagcgtctcaatgggcttccaaacgtccgcgtcaaccagaagaactatgaatggttcctcaacggtgagcgctggaatggctcttggaccactatacaagcgtgacacgatccactttagggccttccttgagggctctatggggacacatcacacatacaacctgggagcatccctatgcgtcttcacgacctaaccgctgcaatcctctcgatgcccgctgtggcaagcgctgaggaagctgtgagcctctccaagttcgctgtgagcctgcaagagcgccctaagttcctcaaggtctaccatcgtgagctggtctacaccgtggggcactggagcggctgggagggccactactggctcgttgaggacaccactgggatcatcttccgggttgactcggtgagggaactacgcgacctcatcaagctctgctccgcatccgtccatgcaccacacgaggtacgctaacatggcactcccacacgacaagttctggcacaccgacaacgtgaccaagttcaagggctacgatgtcaccaacggcgaggttgacctctccgagtccgagtatgaggacgttctggatgagatctacggtgacgtggtgatcctcgggatgacctacggtactggcgctgttctctcgggtgttgatccggtggccttccgctgctctcaaggcgactatgagtcccagctcacggctgagcttgaggagcaacttgagaacgaggacgactctgacgttgagttcgcagacgatgagtgccaagaagacgccgagtgattcactgatgggccttcgctgagggctcattgggaacaactcaacgcaaaccacataggagatccaaatgatccacgcaatcgctcgccagtccaaaaacatctgcctgttcgctctgttcgctaccgtgatcgccctcggggccatccatgcgaatgacgctgaggcacgaggtttctcgggtagtcggtcgagtagctccagctcatcccgctcttacagcgcaccgcgtaccagctcctacaaacctgctcctcgggtcgtccagaacgtcaccgtcaaccgtaccactgtggtccatcaatcggctccagcggccatgggcggtggctctggtggcttcatgagtaccgtagcgggctcctttgcgggcacctctctggcgaactggtggaacaactccagcaacgaggagaaggccgaaaagcaacgccttgaagacgagcagaagcaacgcgacgaggccgctgcactggaacgcctcaagctggacctgctgattcagcaacaatcgggcaagccaatcgagggcatgttgccaccgggcaaataagtacctctctacgatggtcaataagagcctgccttcgcgtcgataacagcgcaaaggtgggcattctgtaccgctccatttaccgcacttcttaggtctttgaattatgcaacgctacaaccgtactaacttcacctcggctgcatttgctgaacgtctcatcgctgctatgcgtggcgctctctctgatggttacgcccactatgtggagaaccggcacgggcaacgctggctccgtgtggacgtaaaacccgacgacttcgggggctacaccttccagttcctcgctggttctggtcaagacgttggcagcctgatcttgcaagcctgcttcgtctggtccgaggagcatgagcgagccttctcggggttgttgagcgaattatacacacgttccgagcatcctttgttgaccgctcgtcgtcgtgatgcagaactggaagctgaaatcaagcccaaacctgcaaaaaatcgttggaaatcagcatttaaagagacccttgggtacttgactgcgcttgcggttggtggtggtgctgggcatggcctcgtcgcattgggagtgttcggatgagtaccgttctcactaaggccaccacgggcatcgcatcggttgacaagtaccatcccctgctgcgtgagcatcttgagaccctcaaggagatggccgcatacgctgaggacaacggcgggatcaacccaagcaagttctctgacacgagcagttggcaaaagttccttgacgattgcgtggtctgccatgcaccggggatctactcggtcgcctacctgcatccgggctactgccgcgacatcaagcacgagatgagcaagttcgtcttcgagcccaaccttgaggagcctcttgaggcgcagatccctgaggtgaccttgcaggatgaacacaaggtgctgttcgaggtcttccggtccttctgggctgacgctgggatcgcctacgccaaggtgctgttcaaccttgagcctgagaacctgaccagcgtacaggctgcccgctatgagccctcagagactccacgaggccactggcacaccgaccgggactctgacgtcactctggtagtggcgctcaacgatgaccatgtagggggcggcacgatggctgctcaagggcctttcttccctgacgtgatggtccctcagaacgaacccggctggggcatgttcttcaagggtaaaacgaccctgcactacggcctgcctgtcaccgagggttgccgacaactactggttcactggagtgaagttaagtgatgcacacgaattaccagcctcgaaagccggggctcattgaccaacaaatcatcaccgcgaagaacaccgttcgcaccgggaaggacgcctttggctactggtacggacgccgcaaggacttcactgaggcgttcctgagtgccatggaagctcgccaagtggtgggcggtatgttgtgccccggcctgcgctacagcgaccgtggggacttcactcgctgctatcggggagggttctgagatgcgtggcttctctaagcgcccctcaatgattccttcgccacccagcgactacacccagcgcgccaagctcatcaagttccgcgcctcgtgggtcgatccgaacacctacgggctcgtcaaggccaaagagctgacctttgagctgggccttgggccttggggtcgtcacgttgtcagcctgggagttgccatcactgatgacctactgacgatcaagcagtggtcacgaagccctgagctgctccatgagcctcaatgcgatgccaagtggaagctggagcggcaccagcgcttagagcgcacctaccggcctgctgtgaccctcaagcggcaagagctgcgagtcaccgggatgctctggtggcgcaaagaggaatgggtcgatgtcattgagaccacccatggtgatgcggtcaagcctgagggtctccttgaggactccgaagtggccgaactgcgagaccagatcagcaagtattactccgctatcacgaagtggaacgatgacctcgaactcaagacatttgtctacaagatggccgacgttcatggccggatcgaggtggttaagtaaggctggattaataaaccctcactgttgcgagacacctcagagggttcctgcctaaaagatcaccttaaagacatcttaaagatccctctgagataaaccttatagagcaattctataagacaactatatctcatagagcatcttaaagaatgatccccgagcgtcacgacttcgctgacatcgcaacatcctcattcgccttcaatcaactctccagcatctacggccccgaactggccgctgagcaactgcgcttggaacacgaagcgtacacgcttggagaggaacgctttcatcgccagatggagcgccagatggagcgcggtgagttctccaacaacatcgccgctcagccgctgctgggcactctggtccctaagatgtccgctgcgatcaccgcatggatcgaccaccaagccaacaagggtcgtggccgtaaacatgtgagcttcgccgctgcacagcaaatgaacccggacacgatggccgctgtgaccatccgctacgttctcaacatgatcgcccagcgccgtaatggtgccccaacggtgaccgagatgagcatcgtggtcggtggagccctcgaagacgaagcgcgctttggccgcatccgagtccttgaggctgaacacttcaagcgagccatcgccccggctctcgccaagcgcaacggtatgacctacaagaaggcgtacatggagcgggtcgaggagtcgatgctacagaaaggcgagctggctcaaccatgggttgactggaacgtcgctgactcagatgtccgcttccacatgggcatccgaatgctggagctgttgatcgaatcgacccaactgatcgaggttcgccgtgatcacgctggggacaagaagaacgatggcgagtatgtgttcctcaaggacgaatgggctgacaagatccagaaccgggccttcgcactggccggtatcacgcctcagtaccaaccctgcatcgttccgcctaaaccgtggaagggtctgcaaggtggtggctactgggccaagggtcgcaagcctctgaccttcatccggctcaacggtaagcaagcccgagagcgctaccgggatgtcgagatgcctgcggtttaccgggcagtcaacatcgcacagtcaaccgcttgggcagtcaataagcgcgtccttgaggtcgccaatgcggtgatggaatggaagaacgtacagatcaaggagttccccacaacggaacgccaagagctgccactgaaaccccacgacatcgacaccaacccagacgctctcaaggcatggaagaaggaggccgctggggtctaccgtaaggacgccgcaagggtatcccggcgattggcctacgagttcggactggagcaagcgaacaagtttgctgagtacgatgcgatctacttcccgtacaacctcgattggcgtggccgggtctacgcggtccctgccttcaaccctcagtctaacgatatgaccaaggggatcttgcaggctgcccatggggaacctgtaggtgaggagggaattgagtggctcatgattcacggggccaacactgcgggcgtcgataaggtgccctttcctgaacgtaaacaatgggtccgagaccatgaagaacttatcttggcgattgccaacgatcccctcaacgtcaccgaatggatgtccatggactccccattctgcttcctcgctttctgctttgagtgggctggagttaaagccaatggcgctgcacacgtttcggctctcccgcttgcattcgatggaagctgctctggcattcaacacttctctgcaatgctacgggatgagcgtgggggtcgggcggtcaatcttattccctcagactccgttcaagacatctacaagatcgtctctgatgaagtcgagatcgctctgcaatatgacctcaaatacgggacggacgattggatcgaaactctcgtcgatgaggtcactggagagatccgcgatgttaagcgtctcggcactaagaccctcgccattgcgtggctcacttacgggatgtctcgtaaggtcaccaagcggtctgtaatgacgctggcctacgggtcgaaagcctacgggttcgctgatcaagtccgagaggacatcgtaaagaaggccatcgacaacgatgagggccacatgttcacaagccccggtgaagcgagccgctacatggctggcaaaatctgggactcggtgagtgttgttgtggtcgccgctgtggaagcaatgaactggctacagaaggccgccaagctgctggcctctgaggtcaagtgcaagaagaccaaagagatcctcaagcctgccatgccagtctactggacgacccctgatgggttcccggtatggcagcaatacacgatcaacccaacgcgccgaatcgacctcatgttcctcggggacgttcgcatccaagccaccgtgatgatgcgcgacaacgggtccagcaagatcaacgcaaggaagcaagagtcgggtatctctccgaactttgttcacagccaagacggctcgcaccttcgcaagacagtcgtacacggttacgacaaccacgggattcgattcttcgccctgatccacgactcgttcggcaccatccctgccaaagctggcgcgatgttccgggcagtccgagagaccatggtcgaaacctacgagaacaacaacgtgctggctgacttccgtgagcaattcatggagcaactacacgagagccaactggacaagatgcctgagcttccaaagatgggaacgctcaacatccgcgacatcctcaaatccgacttcgccttcgcataaggaaaccaattatgaacgccgctcagaacttcgttaagaccaccaaacgtaccctgcgtgatgactccgagatggaagccatccgcaccaagaagggcaagcgcaacaagcccgtccgtggtggtcgcgtagagtggaccccaatctgcaccggcaacgctgcctactaattcccaaccttaggagatcccaatgcaagttatcgttaccgccacctcgtccaaagttgacgacctgatcctgatcgaaacctccaccaccatcggtgacgttacgaccaccgccaagaccggctatgacgttcaagaactgatggacaaccgctttctcagtggtgaccttgagactcgcatcgaagcccttcgggtcggtgccgaggctgtgaccatccgctccgttgaggcgcactttaagaccctgatgaacatcctcaagaagcccgctgaggtgactgacgtgagcgcggccccttcgagccaactgcaaggcgtcaaggctgacgtgatgatcgtcgatgaggcccaggctgaacctgtgactgagccggtgaagaaaacccgcgctcctcgcaagcctaaaaccaccactaccgaatccaactaaggggaaccccatgtccaaagtcgaagccgttatcctgaacaccaagccattccgcccaaccgactacaacgagaaggctgtcgaggctgttctggatgagtcctacctgatcgctgatgtcaagaaggacggcgttcgtttgaacctgtgcgtgaacctgatcgagaccaagcatgaccacggttgggaagtcgagtggttgtcccgtgagggcaagcgcttcccggccttcgggccatctcatggtcctctggacaccgaccctcgctgggctgacttcttcaacgagaacaaaggcgaggggatgttccctcaagggttcatgttggacgctgagctggtcctgaccgacatggatgaccgtgaggttccctgcaagaccacctcgggcaccctgcgccgtaaagaggagtcgatcccactgagccgcatccgggtctacgtcttcgacatcgtaccaatggacgttgtgctgagcggtgaggaatacgaggtcttccagtgcgtccgtaagatccacgttgagtatcaggtagccaagctcaaggaatacttcccagagatccaatggatcgtcgctgagtcctacgaggtcttctcagtggagaccatgccagtggttgagcgtgaaggcttcgacgaggagggcaacgagatcaccgtcaaactccaaccgccactctcgctggtccagctctatacctcggtgcgcgagcgtaaggaggagggtctggtggtcaaagatccgatgggcttctatcgccgctcgaagtgcaacggctggtggaagaaggtgccgagcaacaacgaggacggcaaggtggttggtctggtctggggctcgaagggtaaagccaacgagggcaaggtgatcggcttcgaggttcaacttgagtccggccatgtggtcaacgcttgcaagatcagtaaggcccagatggaggagttcaccaagaaagtgatggaccacaacggttatgacgttgaggacatcgagtcgatcatctacgggatgggcagctcattggttgacgctgagaacccgtaccaccaccacatggtccgagtgacctgcatggaacgctaccctgatgggtcgatgcgtcacccgagcttcgacgagttccgtggtatcagcgatccactcatcaaagagtaactaaacgagcctcatcgacttcggtcggtggggcttttttgtgcctgtctgaataggagaaatctatgacccagttcatcatgatagttttcgttgtgatcaccttcgccatccttatagctggcttcgagcctgaccggactcccatggagcgcctctacgacgaggattaataaaccctcactgttgcgagacacccaaccaaccaccaaaaggagatccaaacgatgcccgttaaagaccgttcgttcgcctaccgtctgcaccaatcgaacatcgaccgtcaacgcaactgcgcccggttcaacatccgtccacctaaaccaccagcgccaaaggccgacttctggcagcgcaccaagacgttcttcaagaacctctggaccaagatcaaggagatcgtcaatgactgacatcatcgccctgacttctgagcgtggtcgtagcggcaaggacaccctgtgcgagcttctgatgatcgagggctaccgggtctaccgggtcgcctttggggatgtcctcaagaagcaatgtagccacatgctggccctcgacgaatgccaacgcatcgttatggagagccacatgcacaccgacttcaaggacgctcagttcgaggagttggcaatcgaggcaatccctgagagcgagtacaaggactggctgctgaacgagccccagatcctcgacatcgagatcccaaggacacctcgctggcacctccagcaatacggcaccggcttccgtcgcaactacaagcagaacccggacgtgtggctgctggagggtctcaaggagatcaagaaggctcccaaagatgccctcgtggtcgtcactgacatgcgtcaagccaacgaatatgcagcactgagcatccgccaagcgcacctcgttcgtctctcccgagactgggcgatccctgctgtggatgaccaaccgttgcacgctactgacattgaactgcgtgacttccaaatggacgccgttgtggtgaacaagtggggccatgcctcggagatgatcgaccaactcagaactcaaggagtaattactcatgcctaagcaagaccagaaaatgaagaagttcctcgtcaccgtggagtaccgcaaggaggtccaagaggtgccaatgtatggccgcaccattgaggaagcgctcgaagctgctgaccttgagtacggtgaagacaacgttcggcgcattcgcccggaggtcactcaatgaacctggcccaaggcaacacccgctcgatgcctgatggcttcctccacatccagaacttcaccgtgaccaagcacgcggggatggctggcgtggtctacatccacatccttgacgcccatcaacgtcagttggtcgaagggctgctcattgagcgcgccatcgttaccgctgagctggaaggcaaggagctgcaccacttcaaacacggctgctggcggttctccaaggagttcctcaagaacaacttccgtgaggtcgtccatgcgatgaccaaggtgacgctgatcccggtcattgagaccttcaagcagaccctgttcaccgagcgtgaatccctctcgtactgaataaaccctcactgttgcgagacacctaccttcccactttcataggagataatcccgatggcaaaatccaccaagcagttcttctttactccgaaaggcgtagctgaaccttactgctcgatccaaaagccggactacggcaacccagagaaaggcttcggcaaccctcgtggcgtctataaggtcaacctgaccgtgagccgtgctgatgcccagccaatcatcgaccgcatcgttcgtatgcaggaacaaagctacgcggcaatctgcgaggacttcgagaagaaccgcgcatcgctgaccgccaagctggcccgtggtaagaaactgctggaaccctatgagggcgacctgccgttcttcgagaacgacgatggcaccgtgacattcaagttctccagctacgcctcgtaccaagacaaggaaaccaaagagaccaagccgctgaccttgaaggtcgtggacgccaagggcaagcgcatcgacgctgttcctgcgatctctggtggttccgagttgaaggttcgcttctccatgtttgcctacaccttcggtgccgttgtcggtgcctcggtcaagctgcaactggatagcgtgatgctgatcaaactggtcgagtacgctgctggcaatgacgactgggctgacgaaaccgaagaaggctacgtcgctccagagcgtgaagaaagctgggacgatcacgaagaccaaggccacgctggcgaggttattcctgacgctgcctcggacttctgatggctggctacgctggcccgaagggcgctcgtacaggcgcttttcgatccggccttgaagaccgcaacgcggctcacatggacaagctcggagtccctttcgacttcgagcagtaccacattaagtacgtcgttccggcccgtgaggccaagtacacacctgacttcgttctgcgtaacgggatcatcgtggagaccaaagggatatgggaagtggacgaccggaaaaagcatctgctgatccgtgagcaataccccgaccttgacatccgtctggtcttctcgaactccaagagcaagatctataagggctccccaacgagctacgccgacttctgcacgaagcacgggatcatgttcgcagacaaactcattcctaaagcatggctacaggagaaacgtaaggagatcccagcggggatactccatccgaaaggaggtaaatgatgccaaaggctgctttcaagaaacgcccaagtacgaccctgctcgtggtccattgcgcggcaaccaaaccgaccatggacatcggcgttcgagagatccgccagtggcatgttcaacaaggctggctggacgttggctatcacttcgtcattcgccgtaacggcactgtcgaggatggtcgccctcatgacgtcattgggtcacacgccaagggctacaactccacctcgctgggcatctgcctcgttggtgggatcaacgccaagggcgccccagagaacaacttcacgcctgagcaattcaactcgctcaagctgctgctgatcgctcacaagcgcacctatccgcaagccaagatcgtgggtcaccgcgacctcgactcgggtaaagcctgcccgtccttcgacgtggccgagtggctgaaaactcaagggatttaataaaccctcactgttgcgacacggcctcactgacttcggttggtggggctttgttgtttttaaacgttgactttaggaggtcattatgaatcgttccttactgcaaggtgggttcgacctttgtgagcatctcattgaccgtggcatcggcgcgattatcgctggtggctgtgcccgtgacctgttcttctcggttgagcctaaagacatcgacatcatttgcgcgggcaccgacccggagactgtttccagagcgctcgatgaaggtggttacacctaccacaagttccccaagtaccacaccggctccgactctgatcggctgcaaggtgtctggaaaatcgaaggctgcgagatcgacgtgattctttacgaggtcgagtgtgtcaccgaggccatccagaagttcgactacaacctcaatcagttcgccatctcgggcatccaaaggggcatcgaaggggcaaccattcgcttcatgggcgctcacgcttggaccaatctggttcaactgcgagaggacgctcgtggctcccgtgctgaaaagatggaagccaagtggctggacctgatccacaaggcaccaatgcgtgatggacgttacgtcgatgagatcgaggtggccgatgtcgtcgcatgaggaacgcgaagaaagcgttttccttgcgcatatcccgtgtgaggaatgtgggtcgtcggacgcaaactcgctgttctctgatggtcaccaatactgctttgcgtgtccccctgagactgcctataaggcacccgatgggaaggagcgtggggagttcacaccgaggctcaaagctgatggcacgctctcgatgggcgaggctggaggctacttctcggcgctccctaagaggttcctacaggagccaatctgccgcctctatggttactggatcggcaaggcgttctcgcctcacgagggcaaggaagtcccggtacagatagccaactactacgacaccgagggcaacctcaagtcgcagaagtgccgtcaagccaacaaggacttctttaccaagggcaagcatgacaaggacgctctgttcggtcggcacctgtggaacggtggccgcaagatcgtcgtcaccgagggtgagatcgactgcctgacggtggcccagatccaaggtggtaagtatccggtcgtgtccattgggcatggctcgaaggctgccaaggcgacctgtgcggccaactacgcctacttcgatcagttcgacgagatcatcctcatgtttgacatggatgagcccggacggattgcctcaagggaagccgctgaggttctcccaccgggcaaggtcaagatcgcagtcctgcctttcaaagacccgaacgagtgtctccagaactcccaggccaaagctgtgatggacgccatgtggaacgctgccccattcgtaccggatggagtggtctctgcgaagtcccttaaggcccgcatcaaggagaagaaagcagtcccgagttatccgctcgtggctccttacgaactccgcaagatgaccaaggacatccgcgaaggtgaggtcgttctggtcacctctgggtccggctcaggcaagtccaccttcgttcgccagaacacttacaacctgttcaatgactgcgggattcccgtaggcgtggcgatgctggaggaggccgttgaggaaaccgtacaggacatcgtagggctccacatggggtcacgagttcgtcagaaccccgatgagaccaccgaggagatgttcgacaaggcgttcgacgagatcttcgagagcgacaagctgcacctctatgacgccttcgctgagtccgctgaggatcgcctattggcgcgactggcgtacatggtcgaagtcaacggctgcaaggtgatcgtactggaccacatctcaatcgtggtctctgcgatggacggtgagaacgatgaacgcaagatgatcgaccggctcatgaccaagctcaagagcttcgccaagaccaagaacgttgtcgtcttcgttatctgccacttgaagaacccggacaaaggtaaacctcacgaggaaggccgacctgtcaccgctaccgacctgcgagggtccggtggtctgcgtcaactgagcgacaccatcatcgctgtagagcgaaaccaacaaggtgccaaccctaacctcatcctgttccgactcctcaagtgtcgattcacgggcgagacgggcgtggctggctacatggaatacgacaagcggactggtcgattggtagcgaagcctgagggctggcgacctgaccaagatgcaactgacgaagctgacgctgcatgggcagaccagcaagaacctgacttttaaaggagaaccaaaccatgaagaacttcgacctcgtaactttcctgatcactctggctggccgcattcaagagaagcgtcacgctcgtctggtggctcgtgaagcgtccttgaaggctgccattacggctgctcaaaacgctctgcagaccaccgttgatcaacgtgtgcaagccaagtggaaacacgaagacatcaagcgcgtgagctgatccaagggcctctctttgaggggccttttagtgagttcacacatcaatgctacaggggggaatacacatgaatggttctgacgttcgcaagttcatcaaacgtggtgagcaggccgctgaggtactcgaaaagctgggctactcgtacatcgagaaggctgggcatcacccacattgggaagctccagtaaacccgatggacccaatccttgaggcgctcaacaagatgatcgctgagaaggttgacgctgacatcaaggcccgcattaaggacgacccaaggggtccgaactggcacctcgttgcgccaatggtaggcaaggacttccgggtccagtgcgccaagatcccggccaatagccaactggcgtcattcgcctttggtcctcacttcgctggcaagttgttccgcgccatcgagatccgctatcaccgctccgaggagtacaccggctatgccgtgctgttccacttcaacgtgcgcccgtatcgcccagaagtcgtatggctgcctttgagcgctgtcgccttctccaactaaggagggcctcatgctcatctctgacatcgaaacgaacgggctctatgagtccgtcactcggttccactgcgccactattcaggactatttcaccgggcaatatgttcggtacaacgagtccaccttcaaggagtacatcgctgcccttgaggccgaagctgccaagcctgacggtatgatcgttgggcacaacttcatcaagtacgacatcccggtcctcgacaagctcaagcgtctctacttcggtaagcgtttgaacatcccaaggaagcgcgtgatggacaccctcgtgatgacccgtttggtttactccaacgttggtgatcgtgactctggtctcatgcgttcgggcatccttcccggcaagatgttcggctctcactcccttgaggcgtggggctatcgtctgggcgagatgaagggcgaatacaagcacgacttcaaggtccagcttgagaacgatggtggcgtctacgttgacggcatggagtggctggaatgctccgagtccatggaggactactgtgagcaggacgttcgggttacctcgaagttgttccgcaagatcatctccgacctgcactacttcaacgatcaaggcgaggccattgaggccatccgattggaacatgcggctgcgtggtcgctggcccagatggaacgcaatggcttccccttcgacatcgagggggctgagaagctctattgtgagctggcgggtcgtcgtagcgatctcctcgtggaactcatccagaccttcgggtcgtggtggtctccgaaaggtggtaagtcgcagttcctcaacccgaagactggcgcaccaatcgactactggtcggatggccgtgtcatgccgaaggtggtctatcccaagatcggtggcgtgttcctcaagagcggcaagaaggacacccgagagaccttcgagggctgcccttacacgccaatcgaactggtcacgttcaaccccggatctcgggcgcaccttgagaaagtcctccgtgatgctggctgggttccgaccgagctgaccaacacgggcgctgccaagatggacgatgagacccttgagttcgtccgtgtggctgaccctaagaagcaagcgtgcatcaaccttgtgcgtgagttcatggaggtcaccaaggtcattgggatgctctctgagggcgacaaagcgtggctgcgatacgtccgtgaggatggctgcattcatggctcagtgaaccccaacggggctgtaacaggccgtgcgacccatagccacccgaacatggggcaagtgcccagcgccaagaagaagtacggacctgcgtgccgtgcgctctttggggcggtctttgcgaggaagctcaagaagggctgggagaacgccgtccagttagggactgacgcctctggccttgagctgcgctgtctgggtcacttcggtgcgccattcgacgaaggctcgtatgccgagaccgtgttgaacggtgacatccactgggtcaatgcgctcgctgctggcatcgctcctcctggcctaatccgtgacaaagagaaccatgaacatgacgcctaccgggacaccgcgaagacgttcatctatgcgttcctctatggcgctggtgatggtctcgttgggtcgttcgttggtggtggcaagaaggaaggtaaggcactcaagaaggcgttcatggagaacaccccggccatctctggcctgaggggagcccttgaggagcaactgatctccgagcagaagtacaacaacgtcaccaagaagtacgacatcaagtggaagcgccgttggatcaaaggtctcgatggccgaaagatccatgtccgctccccacactctgcgctcaactcgctgctccagtccgctggtgcgcttgtgtgtaagaagtgggtcgtcgaggtggaacgcattctcgtcgaggagcatggccttgttcatggctggtacgacgacgatggcaaccccggtgacttctgcttcatggcgtgggttcacgacgaactccagatcgcctgtcgcaaccaagaaatcgctgagctggtcgcaaaggtctccaacgaggccatccgactggtaggcgaatcattcaaattccgctgcccactggctaccgattccaagatcggcccaacgtggcgcgagtgtcactaaggagatccttatgagcatgactctgaaactgaacgtgtccttcccgatgaccatcgtggtaaagaccgagaccctgaaagccttcgacgaaacccgtgaggaggcccgcaagatccccgctgaggagatcgaaaagctcaagggtgagaccaagttccgcgctgagctgttccgtggtgaccgtaccactgagcaagtgatggagctgatctaccgtgctggcatccgtgagctgatccgtaaggaactggtcgaggaaatcaccggcaacgaatcgaccgctcgactgggctgcatcaaggtgacctacgaggctccacctaagcgttcctgtcagggctgcattgagaccaactgcgtgatggccgagcggaacactaacgctggctgcgacaacaagcgcactggtgtccgtgagcccggtcctcgctggactgagacggtatgaatgagtacctaaaggttctctgggaaatcaaaaagcaagcgaggtcgtatcaaagcgacttcgttcgttcccgcattgcgctggtcaacgaggcttcatccagaggccacatctcgtgcctatcaactgccggtaagaacatgggtctctggaccttgaccacttccggccaagacttcctcgcacaatatggaggtgccgtttgagtaaactgaaagtgggcctcgcccatgatatggactacctcatcttctcagcgatgtccgctgctgaggaggagcaggactggggcgaagacgtatggaccctgttctgcgatcacaagaaagcccgtgacattctgttcggcaccatcaagaccatcaaggcgaacatcgccgcacaactcaagcgcaagttcaagctcactgaggacaagtacgagttcgtggacatctgcatcctgagcggtgacgacaactggcgtaaggatgtccttgagacctataaggccaaccgtaagggcaagcgtaagcctgtgggctaccgcaagttctgcgatgagatcatggcgcactacggtgacatgtccctcaagtggcatggtgtcgaaggtgacgatgtttgtggcgtcctgatgactgacccgagcatcgttaagtgtgaccgtgtgatcggcgtgagctgtgacaaggacttcaacacggtgccgggatacttcttctggctgaccgagcaggaactcatcaagaacgatgaggcaacctcggacctgcaccacttctatcagaccctcaagggcgacaccacggatggctatggtggcgtaccgggagtcggtggtgagttcgatggtggcctgatggattggctccagtctccgaagttctacttccaagacgtgaaggtcatgaagtccggcaaacgtaaaggcgaggaggttccgttctggacttcccgtgagcccgatggcgagtccctctgggactgcatggtgtcgctcgctgccaagcagggaatgactgaggaggagttggtggtccaagcccaagtggctcgcatctgccgcgcttcggacttcgatatggagaccatgaagccaatcctctggcgtccctaatttaccctcactattgcgagagggagcccagtgttcccttaaggagtcctattgctcaagcagatccaacactacatccaaaacccggatgacatccctgacatctctcccgcatctgccgactatctcaacgtccgtctcaacgcttcctatctgatctccactggtgctgtcgatgatctccgcaaagcggggttctccgagcagtacatcatgggcttcattgacggatgccatggggcgactgagatcgtggagctgatgcaggaggctcaactaaacaaggaggaatgaccatgtgtttcaagtccaaggtcaagaccccaaagaccaaccctgatgctgtgaaagcgcctgagccggttctcattgaggaacctaaaggcgtggacttcggctcaaccgaggacgatgacacctccagcgatgagggtctcgatggtctcaaggtcaagaagtccgatgtttccacaaaggacactggcgatggttcgtctgatgctgtcgctgctgatacaggcaccgggaccatcaagaagtccaagcctgctgcatccatcaagaaggctctcaagaaggtcactaagtgaacctggctgcgcatgtccagaaggaaggtcacccggcctgcttccgtgaggtgctgagcgacatccttgaggaactcactgagctgacgtggggcgggtccagagtcgaatgctacgagcgcatctgccggtcaaccgaagaacttgacgaacgcatagagatcaccgtgagagacccgcaagggaagctcgtggggttcgctgtggtcgtcaacgatgaggatgaccatgtaggtgagtgcctcggaacgcaatggcactgggttcacccggaccaccgtggccctgtgggtcgaatgatccttcgggcaatcgttaggctggcctccaatgctggctacaagaccgtggcgtacacgaagcgcttaggcgtgggtcgctacgagatcaattacaaacaactgaaggagaacatccatgggcaagaaaattaaaaaggtcgtcaagaaggtcaccaaggctgtcgttaaagtcgctgacccggctggcgtgatcaaggaagcaactggcggtaatgatgcacctgctcaggtagtcgaagcccctgctgcaccgacccctgtggctgcccctgcgcctatctcagcggctgtcgtggaggccccgaaggataccactgagggctccgatgatgctgacactgaggctgccaagaaggctgcccgtgcgcgtggtaaacgtggtctgagcgtggctcgttccgctggtactggcatcaacatctaaccaaggaggtgacccgtggcgactacaactcgcaccgggctcgctgaggagggcgcaaaggctgtttacgaacggctgaaaaacgaccgagttccctacgagacccgtgctgaaaactgcgcgaaggtcaccatcccctcgctgttccctaaagactccgacaacgcctctactgactactccactccgtggcaagcagtgggcgctcgtgggctcaacaacctgtctgccaaggtcatgctggctctattcccgctgcaaagctggatgaagctcaaggtgtccgagtggcaagcgaagcaactggtctccgacccttcgcaactggctgtcgtggaacaaggcttgggcatggttgagcgaatcctgatgtcctacatggaagccaactcgtaccgtgtgacgctctttgagctgatccgtcagttggcccttgcagggtccgctctgatctacctgccaccaccagacgcatcgtcgtctgcgtacaacccgatgaagctctacacgctccacaaccatgtggtccagcgtgatgccttcgggaacgtcttacagatcgtcaccgtggataaggtcgcctttgcggctctccctgaggacgttcgcaactctcttggcgctgatggcgagcgtaagcccgaccaagagatcgaggtctacacccatgtttatcttgacgatgagtctggtgagttcgcttcttatcaggaagtggatggtgtcgaagtcgatgggtccgaaggtcagtatcctctggatgcctgcccgtggatcgctgtgcgctggaccaaacgtgatggcgagcattatggccgctctcatgtcgaggaatacctcggtgacctgaactcccttgagtctctccacgaggcaatgatcaagttctcgatggtcgcctcgaaggtgatcggactggtgaaccctaacggtgtcactcaggttcgtcgtttggtgaaggctcagactggtgactttgttgccggtaagaagtccgacatcgagttcctccagttggagaagaccgctgacttcacagtcgctaagtctgtcgctgatgccattgagcaacgcctctcctacgtcttcatgttgaactctgcggtacaacgcaagggcgaacgtgtgactgccgaggagatccgctatgtggcgagtgaacttgaggacacccttgggggcgtctattcgattctctctcaggaactccaactcccaatcgtccgcatcctgttgaaccaactacaggcaacctcgcagatcccagacatgccaaaggaggccgttgagccaactgtcagcactggtgtcgaggcactgggtcgtggtcaggacttggacaagctcaatcagttcttgagtgcaatggctaacgtgagtcagctacaggctgatccagacctcaacatgagcaacatcaagttgagactggcgaacgctataggcatcgacacgtccggtctgctgctcactgaggccgagaaggctcagctccaatcccaagagatgctcaagcaaggtggcctcaacgctgctgccggcatcggtcagggtctcgctcaacaagcgaccgcaagtccagaggccatccaaggcgctatggaaactacgggcatcgaagcggccccgatttaataaaccctcactattgcgagacacacgttctgccaagcaagtacatctgggaaacctcggatagtgcccgaggcgtgtgtctctccattttctaaaggagacccaatgagcaacgaatcccaagctgacgtctatgcacacttcggcgtgaatagcgctgtgatgaccactaccaacatcaccgagcatgagcaagcgatgctggcaatgcccgtgtctgttcgtgatggcgatgactccatcgagatgcactacgaggacgccgaagaaggctccaacgagctgcaactggataccggcgaggacaactctcaagagctggaattgacgaacgaggagggcactgacgaaggtgctgactccgatgagttcgtccctctgggcgaacctgacgctgacctgatcgaagcctctgaggccgtcgatgagtacgctgatggattcactcagatgcgcgctcaagcgatcaaagcgggcctgccacaagaggtcgctgaccagatcgaggccgagtatgaagctgacaacaaactctctgaggcgtccttaaaggcgctggagaaggttggctacagccgtggcttcgtgaagtcgtttatcagcggtcaagaagcactggctcaaacctatgtggcccagatccagcaatacgctggtggtcccgagaagttcaaagccatcgtggctcacatgacggccaactcccctgatgctgttgaagcattggagcgagccatccagaaccaagaccttgcgtccatcaagacgctgatcaatctgggcatggcgagccgcaccaagaagttcggcaagacaccggaacgtagcgtcactaagcgtgcccctgcaagtggtcctaaacaggcccctcaaggtccacaaggctatgcgtctcaggccgagatggtaaaggcgatgggagactcccgttacgctaccgacccatcttaccgtgcccaagtcgaagcccgagtgctgcgcaccaactggtaattaataaaccctcactattgcgagagatacctatccgattccttcggaggatctcttgcgcccttaagaatttcacaaaggagaactaatacatggcgaacatgaatggcggtcaacaactcggcgcgaaccaaggcaaaggccagaaccctgctgacaaactggcgaacttccttaagctgttcggtggcgaagtcctgacggctttcgtccgtcgctccgtgaccatggacaagcatatggttcgtaccatccagaatggtaagtccgcttcgttccctgttatgggtcgtaccaaaggttactacctcgctgctggtgagaacctggacgacaagcgtaaagacatcaagcactccgagaaagtgatccagatcgacggtctgttgacctcggacgttctgatctacgacatcgaagacgcgatgaaccactacgatgtccgtgctgaatactcggcacaactgggcgaagctctggctctggccgctgacggtgctgtactggccgagatggcgaacctgtgcaacctgcctgccgctaccaacgagaacatcgctggtctgggcactgccgttgttctgaacatcggtgctgctgctgacctcgttgacgttgaggctcgtggtaaagcgatcctgaaaggtctgactctggcccgtggccgcttcaccaagaactacgtccctgctggcgaccgtcgcttcttcacttcccctgacgactacagcgcgatcctgtctgctctgatgccgaacgctgccaactactcggcactgatcgacccagagaccggcaacatccgcaacgtgatgggctgggaagttatcgaagtcccacatctggtcgctggcggtgctggtgatgacgacctcggcactaaccagaagcacgccttcccggccactgctgctggcgatgtcaaggtagctcagaacaacgtgatcggcttgctggttcaccgttcggctgtcggcaccgtgaagctgaaagacatggcgctggaacgcgctcgtcgtcctgagtaccaagctgaccagatcatcggcaagtacgcgatgggtcacggtggcctgcgtcctgaggctgctggtgcgctggtcttcaccccggctgcctaaagccaactaaccccttggggctcctaaccgggctccttggggttttttttcattcaacgaaaggagatcaacatggcctatgaatcggtcctcgactctgatgacgaactcgatgctgtcaatgacatgctcgctgccatcggtgagtcccctgtaagttccctcgaaggtgaccctaacgctgacgtagcgaactgccgtcgcattctctccaaggtcaaccgtgagatccaagcgaagggctggacgttcaacattgaggagggcgcgatccttctccctgacgccttctcgaagctcatcgagtacctgcctgactacctgcgcatgaccacctcaggcggcaccctgtacatcaaccgtggtggattcgtttacgaccgcaccgcgaagactgatgtctttgaaaacccaatcaccgtggacctgatccgcctcaagcaactctctgagatgcccgagtgtttccgctcgtacatcgtcgctaagtcctctcgtcgattccaaacccggttcttcggtgctggtgagatcgagggctccttgcaggaacaagaggctgaggcttgggcgtccatccaagagtacgagctggacttcggtggcttcaacatgatcacaggcgatgcgttcgtcggtggtatcaccaaccgctaaggagggcctatgggactcgtttcgcaaagcgtcaagaacctcaaaggaggtatctcgcagcaaccggacatcttgcgtttctccaaccaaggtgccatgcaaatcaatggctggtcctcggagactcagggtctacagaagcgaccaccgaccaagatcatcaagcgtctgtacagcactggcgcactgggcgtgaagcctctggtccacatgatcaaccgggactccaccgagcaatacttcgtgtcgttcttcgggtccggccttacggttcatgacttggctggcaatgagtatctggtccgtggttacaacggctacgccaactgtgcgaaccctcgtgatgacctgaggttgatcaccgtggccgactacaccttcgtgaccaaccgtaagactgtcactcagttgggcggtacgctgactggtgctggacaacctaacgtgaccactcgtgggcttgtgaacatccgtggtgggcagtatggccggaccatgcagatcctcatcaacgggggcgtctacgggaacatccagatgcctaacggttccgctgagaaggtgcctgctgggcagccttacgctggcatgaaccaagtggacatgacggacgccaactggatcgcctcaacgatggccgctcagatcaacactgcgctcaacgcctcgggctggtcggcaacctctggccccggctgggtcatgatcaccgctcccggccccggtgggtttgtttcactccagaccaaggatggctacggtgaccagctcatgaacggcttcatctaccaagtccagacgttcaacaagttgcccgctcaggcccctgatggatacctcgtggaagtcactggcgagtccgctcgcacaggtgacaactactgggtccaatacagcctcgctggtaaggtctggaaggaagtggcgaagccggggatcatcgctgggttcaatagtgcgaccatgcctcacgccctcatccgggccgctgatggcaactttgattggaccccgctgacatgggatacgcgccagtgtggtgacgatggaaccaacccaatgccgtcattcattggtgatcgcatcaacgacatcttcttcttccgtaaccgtctgggcttcattgcaggcgagaacgtgatcatgtcgaggaccgctaaatacttcaacttcttcccggcctccgtgagcgctcttagcgatgacgatccgattgacgtagcgatctcgcataaccgtgtgagtatcttgaagtatgccgttccgttcgctgagcagttgctgttgtggtcggaccaagcccagttcgtattgtcgtccgctggggttctctcctcgaagaccattgagttggacttgacgactgagttcgatgtctctgacggtgcccgtcccttcgggattggtcgtggcgtttacttcgctgcacctcgggcctcctacacatccctcaagcgttactacgcgatccaagacgtgagtaacgtgaagtccgctgaggatgtctccgcacacgtcccgagctacctgcccaacaccgtgttcaatctggctgggtcaggaaccgagaacttcgtgtcgatgatcagtaacgggcaaccgggcaacctgtacatctacaagttcctgtacctcgacgagatcctccagcaacaatcgttctcccactggaacttcgggaccaacgttaagatcctcgctgcgtactcgattggctcctacatgtacctcatgttggatcgccctgaggggatcatgatggagcgcattgagttcactcagtccaccatcgacatcgctcaggagccctaccggacctacatggaccagaagaagctcatccagatcggtgcctatgacatcgacctccaccgtagcttcgtgagcatcgaatccattctcggtggcctgccatcgggcgactccgtgttctacacgattgaccagcaaggcgtgatgcagcgacatgaaggtccatggccttcgggttctggcttgtcctttccgggcaaccgggctggtgagtatgtggtcttcggtcgtgagtacgagttccaatatgagttctccaagttcctcatcaagcagaccgctgacgatggctccacctccactgaggacatcggtcggctccagcttcggagagcatggttgaactatgagaactctggcgcgtttgaggtcaacgtcaacaacggctccactcagtacgtctacccgatgtctggtggtcgccttgggactcaaacgttcctcggtgagctggctctgggcaccgggcagttcaagttccctgtcaccggcaacgcccaggcacaacgagtgacgatcagttctgcaaaccctaacccactcaacatcatcggatgcggatgggaaggtaactacattcgccgttctggcggtatctaatcgactggcatggtgggggtttatttaccctcactattgccctatgggggatctttatgattttacagaaagcacaacgctggcacctcgaagctgctgcacgagacctcagtcccggtgacctccaagagttccactcccacacggctgggcgcgatccacgagacaccatcccgaactgcctcgatgacacctcaatggtgatcactaagggcgctctggtggtggctgtaggtgggtccaaagattgcctctggtttgtgactaccaacgtggtggacctgctgaccaaggctgaacgtatggagttctatcggatgctcaaagggcatctgagcgtactcaggctgcaaggccatcaatccctgaccaacttcgtgtcagtggacaatcacgcccacatccgtctcctcaacgctctcggtgcgaccttcgcccgtgaacaccacatgagtcctgccggatgtcggttccgtcaattctggctataggaggtcaccatgtgtgaaccagtaagcatcggcatggctgctgttgcggttgtcggtggggctatggctgccaaggacaaggccaagggtgagggtaacgctgaggatgctcaacgtcgcaccgcccgagagcaagtcaagcagaccaacatggctaacgccaacctgcaactgactgcccaagaccgtcaagaggaggcccgagcgcaactcgctgaggtcaacatgcaggcgctcaagaataaaggaacggtggctgctgccatcggggagtcaatgctttcgggcaactccatcaagcgtattgcgaactcagtggatgtcgaggccagtcaacaaaagatggcgatcaccgacaactacaagcgcgactattcgtcgatctttgcgaaccagattgccaacgtcgagaacaccaagtcggccctcaaaggtcaggctcaagtgatcaagacctcgggtctgagtcacgcccttgggatcgtctctgcgggggccaatggttacgccgctgggtcgtcattgaaaggtcagatgaacgccaacaaggcaactggacaatccaacggtacagctaaaggaggaacttaatggctaatgaaattgcacgagctttagactcggcccaaatgggcggtaaggaacgccttaagggctccactgcgaccgtccagtttcaagcctctcagcaacgtgctgacgtaggcaacaatggcttcgctgactccatggcgagcttcgtgaaggccggggcgaatgcctatggcacctacgctcaggacaaggcgaagaacgctcaggctgagtcggacaagatcatccggtcgatgtccctccagcaacgccgtgaggctatcgcagcgggaaccctgcacctacaggatgaccctgacgtgatgaacgtcctgcgtcacgacactggccggacggctgcctttgaggtggagtccgagatccagaacaagctcgcctctggtgagttcgacaaccaatcccgtgaggaactggatgagtatcgccggacccgtctggagatggtctctcagtcctacgctcaggaagcgggtattgaccctaacgatcctgactaccagcgtggctttaacgccgacatcgtgaagcgtaatgcgggcctattcgacttgcatgaccagcgacgttcccagcgctacattgctcagactgtggtcaacactcgtggcgacactggtggtcttctggatgaccctgagttcatgcgtggtccgggctctggcatcgagatggctgcctacttcaaatcgaaggcatcctctggggcaatcccaacggaccaagcgctcctcgattcagtcaacctcgtgatcaacgatgcggtccagaaggaccacggatcgaccttcctcaagaacttccgagatcagacgatcaccgtgatggggattgagcagaaggtcggtgacgtgatcggtcaggagaaatacgacaacctgatcgccaagtccgctgaggccacctacaagcgcaaccaaccgaagttcgagaagttccaactggatctcgcttcggctgaggctcaggctgacccggcccgtggctgggatatgatcaatcggatcgaggctgagaataagtggattcaggatggtgatggcttcactcagcaaaagcaggcggtcaccagtaccaagctcgccatgctggcaaagatgaaggcccacactcaggcgacccttaaggcaaccgaggaggcgatgcagacggacaaccgcttgcaggccatcgacgaccgctacaaggctcgccgtaatggtgccctcttggggaccgctaagcaggacatgcctgtcgatgccaacactggagagttcaaggagtccgactgggcgacctacgctcaaaagaagctggctcagatcgaggccatggacatcccggtggagcagaaggatcttgagcgcggtcagctcctcaaggacgaccacgagaatggtcctttccgtcgaggcttccaaacgctgatcgacgatgcagccaaggaatggcaaggcgctgttcaattgggcgaactcggggactccccaaagattgaccaactggcacgggtctatgcccagcaaccggaactcattgcgtcactctaccctgagcgcgctggcttcatcgaaaagatgaaccagatgaagcacgttgggattaacccatcggtcctcattgcggctgacgtgaagaactccaagctgaccaaggaggagatgatccaacggaacatccaatgggacgccctcaagagcgaccctaagaacaaggatctctcagcgattccgaacgacatggacaccatggctcgttctctctatgacgccttcaacgctgcaactggcgaccctacggctgcctccaagttgctctccaactggctctcgaagaacaccgttagcttccaagctggcgatgaagacgaggatgtccagaccggctaccaagggatgatcaacaagaaggatctcatggccgacccgaacgacgttaactcgtgggagcagggtaaggccatcgttgaggagaccgttaagggtatcaaggctgctgacccgtactgggctgattcgcctgtgaccatcaccgcttctcgaactggtgacatcaagatctccaccttgactggtgaggtcgtgaccatcaagaagcaatccctccagctcatctacagcgctcgccgtcaggcggaactggaagctcagaaggccaacaaggctgctgagtacgatgaggacgtgaaggacgcacaacgcaatcaaggtctctacaaagactttatccgagggggtcgtggccctctctaatccaatttaggaggaacacatggctaagaaaacctacgctgatgtcaaggccgctggcacgccttacgatggtttgattcgtgaggctgctgatgccaatggcgtgagctatgactacctgcacaaaaagatctttaacgagtccagcttcaaccctcaagctcagtcaccgactgggcctcggggtctgggtcagttcactcgtgccactggcaaggcatatggtctcgttacagacgaggacttcttcgaccctgccaagtccattaatgcgtccgctcgccacactgcggacctcctcaagacctacaaaggggactacctcaaggctgcccttgcgtacaaccaagggaatggccgcttaggcgctccccagttacaagcgctggatcgtggtgacttctccaagatcgcccctgagggtcgtcagtacatggcgaaccttctggacgtggctggtgactcgccgtcccgcaagtggttcgagggtccagatgccccaaagctaaccgctgagttccaagaggctacccaagggatctcagcaacaccatccgttgaacaaggtagcctcggtggaaacatcgggatgaacatcgggggctccactgcgcctgcccaagagaagtcgttccgtcaaatggagatcgagcagaacggcccagagaagggcgcatggtacggctcctctgaggccatgttggctgccttgaagacctcgcttcccggccagatctaccggaacatcaccgtcgaggatcatgacccactggagtggatgcaggacacgggtgaccgtgagtggtccaaggaggactacgaccacatccgtaatgaaggtgtcgattcgcaatacttcgacttcattggcgactacacccggtacgacaagcgcaagctgcctgaggccatcgctctcgctaaagagaacatggctcacgacaagaccatcacatccgctggctggggcggtcaactggctgctggtggcgttctcgctgctactgacccactgacctacgtccctgttccgggcaccgctctgcgaacctttggtggccgtgtgttggctcaggggacattctcctctggtgccgctgtggctggtgagggtattcgtgaggcgaccactgggattgagggccactacgctaccgctgctgtaggtggtgctgtgatcggcggcaccatggctgctgtcttggacaagtggattgccaagtcactcgttaagcctgggagagaagacatgagcgatgaggaactcgaaaaggttcttgctcgccacggtgaggctggtctccaatccaacgatgtcaaagtcgatgaggacatgctggcctccgctcgcccctctaaggttgacgatgagatggacgatgagtacctcgaaaagatcctcgggatgcacggtgagcgctcccacaaacaagagggtcgaatggaagtctctgacgacaccgttgagggcatccttgcgaggcaccgagagtcgagccaaccgaacgagttcatgggtccaaccatccgcatcaatgcccgtgagcaagctcgtttggctggtgctgacgaccctaccgttatggcatggaagtccgatgagacccctgatgaagccttcgggattcagtacatggaccacccaaaggaaccgggcgctgtgcgtcttcctgatggttcgatcctctcggccagcaacccgctgaaccctaagctcatcaaagcgatggcctctctggagcctgagcgagccgctgctgggttcaagttcggtggcctgactgagatcggcctaatgctgctgcgtagcgaggatgaggagctgagaggtattggcgctcagttgttccgttcgcctactggtggcgtctctgggtccaacggtaagtttggcgctgtggcttctgacgtgatcgagcgtgagcgtggtcaagatcatgtggctctaaacgccatggtcgatgcccaacaagaagccatgaaggacgtctcggtgaagaccctgcccggtggccgtcaggctcagcgtgagtatgtggatcgccgtatcgctgaggctatcgaagaccctacaggggccaagctggctcagctcactgaggccgagaagaagtacgccaaggtcgtagaggatcactttgtacgcaaagagaactcccttgagaaccctgcgcagtacggcaacatggatgccacttcgatcatgcctcagacccgtcactctggtcggtacatcccgaacatctacgatgacgccatcaagctactcaacctccaacgcttcggcggtcctgagggtttgcagaaggcaatcgttgagagctggatggcttcctatctgagccgtgctgctgtgaaaacccgagtggacaagatgatcaaggagtcgctggaaaagaacggcaaggtggcaacacctgaggacatcaagaaggccgttgtcgagtacgcctacaacaaggcatacggtatcagccacacgactgacttcaaccgctcctcgctgatcgacgataacctcgaaggtctggtgggtcaggatgccaacaacttcctcgaaggtcgtcacctgtttgactcggacgtggctgtatcgctgagcgatgggacaaccttctcggttaacgacctgcgcatctttgacgttcctcagatcacctcctcgtacaaccgtcgagtaaatggtgacatcgggatcatggctgccactggtaaggacaccactgcccttaaggacgcgatcctcaagatcaaggccaagaatggcaacactcaggaagtggaagccttgcaggagtccatcaagctgctcactgggcgctcacgtcgagaccctgactcagcggctgcaacactggctcgtgccttgactgacgtttcgttcttcaccaagaacgcctacatgggcgctcagaacgtcactgagatcgctgggctgatcactaagggccacactcggatgctcatgaagggagtccccttcctccgtgagatggccacatggggctccaagatcaaacctgagcaactcaaggagatgcacgacatgatcttcggtcgggagctggatgacctcatccgtcctcgccgtgctgacatcgtgcaacgcctgcgtaaccaaggctacagcggggccacggctcagactgtgggcaccatcaagttcgccactggtgagctggctgcccgttcgcctttcaccaagttcctcactgagacctccaactacatcctcgatgctggtcggcaaggtgtccttgtggacctcgtgaaccatgcgctctctgggaagacctcgaagctgttcaatgaggatcgactgcactcgatgtcgatcaccaaggctcagttcggtgacgtgacgaatgccctcaaggagcatctcgtggctgatccaaaaggtggcttcaagatccgtgatcgggccaagttccaacaagaccctcgggtaatggacatctggcggattggtgacaaggtggccgatgagaccatcctgcgtccccacaagctgagcaacaccgatgccattgcgcagaacgcttgggtcaagctggcgatgcagttcaagaacttcgtcctgcgttcggtaaacagtcgcctcctacggggcttctataacgccaccaagaacaagcaggccatcgaccaagcccaacaagtggcgatctcgatgggtctcgcctcgggcttctatgtggcccagcgctacgtccaagctcaagggatgcctaaagaggaacgccgtgacttcctgtcgcggtcactggacatgaacatgatcgcttatgcagcgggctctcgtagctctcacgttggtgcccctttgggtatcgccaacttcgctctggcccctctggggttcgatgcggctgctgctgtgcggacctctgttttgcctcgtggacctcagtacaccgaacggaaccgggctgtgaaatattccccgctccgctcctcgggcatccaagacccgctctcgaagttcgctgagcaagtacctggcctcggagtcctcgggtcgatctatcagattggcaatggcaccgctggcgtgttccgcgatgaaggtcgggctcaggatcaggactacaagtctgcgatctacaacgggttccgtaacctcgtgccgaacgaccctgccactcagaaggtcaccaacatgcttttccaagagatgggcatggagtacggcaagcgcggccagaaggtccgttaataacccctcactattgggatacatcaactcacgccctgccctaacccggtggggctttttcattaaggagaccacatggcaactaccaccaagacggtgaagacgtatgccctcaacggttccctcaaggacttcacgattccattcgagtatctcgctcgtaagttcgtgagtgttaacttgatcggcgcaacccggcaagagcttgtactcaacgtagacttccgcttttccactccgaccaccatcaccaccttgcgtggttctgcgtggggtccggctgacaacttcgacctgatcgagatccgccgttggacttccgccactgagcgcctcgttgacttcgctgatggttcgatccttcgggcctacgacctcaacaccgctcagattcaatcgctccacatcgctgaggaagctcgtgacctcacggctgacacaatcggcgtgaacaacgatggtcaactcgatgcccgtgcgcggcgcattgtgaacctcgctgatgcgatcaatcccggtgatgctgtgaccctgcgccaagagcaacaatggggcggctcagcgctcaaccaagcgaacctctcggctgcctctgcggctgcctctcaggcttcccggctggcttctgaaagtgcccgcgatacgtccatcacttacgctggcgaatcgtacacccatcgaattgcctcggagaccgctaagaacgcctcggctgcctctgcgacaaactctgagttgtccaatcagactgcctacaagtgggccaacaaccctgagaacaccgtggtcaataccgggcaatactcggcctaccactgggtccagaaggcaatcgcccatgtggctaccgctctgggctacgccaacgctgcctcatcgtctgccactcaggctgcccaaaaggtgaccgatgctcaggctcaagtgagtctcgctgctgctcaggcgaccatcgcaaccaacaaggccgctgaggctgccacaagcgcttcccagttgggcggtgcgattggtattggcgacaacatctcgtccactgcgagcggtgatgggaactggaaggtggtctttaagggcatcgtacaggctgtcggtgcgttccttgggaagcgctttgaggctgagccttatgatgaggccaacggcttcgccaaccaatgggcgaccactgccccattcatgtccaaagagaaggccctcacgaacgtctcagcgtactacccgattgttaaaggcaagtacagtcaaggtggtgtcggtgagactgcctctatgggcgtccttacgaatacgaacggggttcactcgctgacattccattggggcaactcgggtggtggtggcgctggtgccctcctgcaaatgaccaaagatggggcgattgctcagttctctggtgcgctctactctggtggtgcctccggcatctactcaggcactggtggtgtgtgggatgcaggtaaccgcgtgtggtcaactggtaacttcaacccagcctacaaactgggtggtactggtgggaccacaacgatgggcaacaacaatcaagtctgtggcgtcacctacacgaacctctcggctgccaaccaagtttacaacggtgcctttgagattcgtgagagcggcctcgtaggtaatggtggaccagctccgggtcacatctacaacgcaccgggtatctccttccactggggcgcgaccgttgtttctaagctgatgatgaactctgccggtcacttgtgctggggcaaccctgccgcgcagtacatgcagatctccccggatgggaacatcttcggttccgttttcggtaaccagtgggcgaacacctacatctacaacaccgccaatgagcgtgcaaacgcttgggccgttcaagaagcccgcaacgtcaacaacattggcatcgccatgtccagtctgcgagtcaactcgctgggctgccacatgctggctctggctcacaacaactcgggcgtggagtggaacgaaggtgtcgctggcggcaacctcactggcaccaacactggtggcacttacttcgctggctacaacttggccggtaactacgttcggatgggtaagttggttaacgctgacggcgcatcccctgactccgtgaccctatacatgcgctatgcgtaaggaggattaatggctaacagatctatcgtggacgtgaagaatgtccaatggtgctgccctaacaaggatgcagcctactgcctcgtaaagttctcggacatcgaggactacatcgagtacaccgctgtgcgtggcgacgaagttgcgcatggcaatgaactattccagatcatcgaccgggggctcgctggggacatccctgagtatgccggtcccgaccaatcgcagatcgaggcatggaacctgctcatggaggaggtctctgcgcttcgtgtggagttcgacaagatcatccctgaggtccaattgggcctcgctgcacctgagcgtgtagagcgcgccaagtacctctatggccgcatcaaggacatcgagtcgtaccacaaagcgacctatgacatgacgttctgctacgtcaaccgtgaggtgtcctaatgggcatctctatcgacttcaacaacggggtggtgcaagccactccagtcgtaggtgctgctgtaactgacgtgacggcccggttgtttctgggcctttcaccaagtgagtggttctacgcatccgccgttttgtactccctcgtgatgactgtaatcgtggtttacaagaccgttaaagaagaacgccgaaaagacaaggaggctgagaaatgagtgatgacttactgatgcgcctgctggtcgcgctggacactgacatggcgaagaacatgttggctgacctccgtgatcctgagcgtagaacgcctcagctctacaacgctgtgggcaagctgctggaacgacacaagttcaccatcgccaagcttcaacctgatgagtcccttctgggcgatctcgcttcggctctcgatgagatccctgagttaactgacgacgagctgtacgcctcggacgttcgccactaaaggaggccctgcatgttgaaccttaaagagttcgtcatgtggggccttttggtttgcacaggcttaggtctgacgtatgccaaaggtcactctgacgcaaccgacacactgaccctcaaacatcaaactgaacaactggcggctgcccgtcaactggaggtggaacgtgaaacaacccaaagagccctcgctgatgtctcgaagaactggcaagcctatctctcaacgagtaaggcatctgctgatcggactattgctggtctgcgtagcaatggtatcagcctgtcagtcgccctcgcagatgccaccgtcaagtgcgtcacggctgacggtagacccctcgctgatggtcgcgccgagctacgagaaagcgatggtcgatttcttatcgaacaagcccaacgagcagacgcccaagtgaagggcctgcaagattccattaagaccatccaaggaggaactaa

SEQ ID NO: 9 - DNA, 41721 bp, unidentified
  misc_feature 1..11: note = bacteriophages nucleic acid sequence
  source 1..41721: mol_type = genomic DNA
cctcgtggcgctctgggagggcctccatggaaaacacatcgtaggtctcagcaacccgccagtcgatctcgggaaagtattccttgagcttggcgacttggtactcaacgtggcccttacggacgcactgcatgacatcgtattcgatgcccagcgcgatcacgtccagaggaacgatgtcgaacacgtagacccggatgcggtccatgggaaccggcttgtccttgcggcgcagcgtaccagaggtgtccttgcaggcaccctcaccgcccaagctgtccagcaggatcagttcagcatccagcatgaagccctcgtcattgaacagagcttcaccgatgtgcgggttatagaacttcgaccagcgtgcatcgccttgcaggtactggatcagagccgggaagcgcttaccctcacgggacagccactctacgttgaccactgggtcccggccagacacgcacaggttgagacgaacgccatccttcttcacgtcgcaggtcagataggactcgtcgagcatggcctgcatggctttctcgttgaagtctgtagggcggaacggcttggtgttgaggatgacggcttcgactttggacatggtgggttccttatttgatgacggttacgtctgtgatgtaggagtgcgggactatgtggatgccgcatttaccgctaactcgatccttcaggacctcgatacaggccatgccgggttgatcgacaacgacgagggacacgattcgatagatcagcgaggcgcgctcgcttgcttggcggttctcgtagatgttcacgctgtcttctccgaggttgcctttgtggtgcgggccttgcgggtcttcttcacgggctctttcggggcctcgtcgaggaccatcaggtcagccttcacgcccttgagtggagcggtcacctcgaccacttccggctccggtcggtcctgcttagcgagggtctcgaagtgcaaccgaacagccgtctcggtcatgcgctcggcaccttggcgcagggcctcaatgcgttcttcgagggtccctgcgagatagcggttttccatcagctcattgactgggtagccgacacgttgcttggtgacgttcccggcgatttccacagaggtctcgatgaggaccgtttcggcgtccaccatggacgaggtagatttgatgatgacttccatttagatggtctcccattcagtgcgctgggcgcgattggctttgttgagtttgcccttacgagcgcggaccacttccatctcggactcttcacggcgcggagcggtcttgcgggttttctcgaagttcattgcggagttcattatttggttcctcttatgcgaaggcaaagtcagatttcaggatttgggtgatgtcgagtgttcccttggccgggatctctggcatctttgaaagttggctaacgtgtagttgctccatgaattgctcacggaagtctgcaagtacatcgttgttctggtatgtctcaaccattgtttcgcggactgcccggaacatcgccccagcttttgccgggatagtgccgaacgagtcgtgtattagtgcgaagaagtccaagccgtatttctcatggctccacactactgttttgcggaggtgcgaaccgtcctgagagtggacgaagttcggagagatacccgattcttgtttccgggcgtcaattacatcgctatcccgtacagtcaccgttgattgcaggcggatgtccccgaggaacatcaggtcaatccggcgagtctctgggaccatgtattcctgccataccgggaagccgtcaggcgtggtccagtaaacaggcattgcaggcttgagaatgaccttcttgtccttcttgtccttgacttcagatgacagcaacttagcggccttctgtagccagttcatcgcctctacagcagcgactacaacgacactcaccgagtcccagataagaccagccatgaagcggctcgcctgacccacatcggtgaacatttgaccctcaccgttatcaatcgctttcttcacgatgtcatcacggacctgatcggtgaacccgtaggctttcgagccgtaggccagagtcatcacggaccgcttggtgacctttcgggacatcccgtaggccagccatgccatagcgagggtttttgttccgaggatgagtttctcagtgatctcgccggtcgtttcgtcaacgtagatctgcgtggagttctccgttccggtctcagcgaggacctttagggcctgctcgacttcatcagagacgagcttgtagatgtcctgcacggaatcgctgggaagcaggttgacagctcggccaccacgctcatctcgcagcattgcagagaagtgttggatacccgaacagctaccgtcaaaggcgataggcagcgcgctaacgtgtgcagctccgtctcgctgtaccccttcccactcaaagcagaaagcaaggaagcaaaatggggagtccatttgcatccattcgatgttgttaagtgggtcatttgcgcacctcagaatcatgtcttcgttgtcgagaacccattgacggcgctcattgaaatcaaccttgtccacgcctgccgtgttggcaccatggatcatcagccagccaatcccttcgtccccgatgggttcccctttagcggcctgcaagatccccttggtcatgtcgttggactgagggttgaacacagggatcgcgtagacccggccccgccagtcgaggttatacgggaagtaaatcgcctcgaagtccttgaacttgttggcctgctcgatggtgaactggtaagagatcctacgagagacccgagcggcgtccttgcggtagaccgcagaggctgcctttttccagtccttgagggcctcttcgttggtgtcgatgtcccaaggcttgatcggcaaaggttcttgctcgacccgtgggaactccttgatcggcacgttggcccacgtcatgacgctgttcgccacttcgaggacgcgcttgttgatgctccatgcggtgttttgagcgaggttaacggccttgtagacctctggcatgtgaacgtcgcggtagcgcttcagggctcgcttggagcggacccggatgaacgtcacaggcttgcgccccttggcccagtagccgccaccgtgggtcccttgccatggcttgggttgcacgaccatcggctggtagcgcggaaagacaccttgcaggacgaaggcccgagaggtcagcttttcggcccattccggcttaaggtagatgtactccccgtcaagctttttgttgcctttgtgctcacggatcatctcgatcaactgcgtggactcgatgaggagttccagcatgcggacacccatgtgatacaggatgtcgggcgtgttagattcccacggctgccaattaccgttgaccttgccgtccttgaccatctgggcctcgatcttcgccatgtactccagcttgtaagtcatcccattgcgttgggcgagggacttcttgaggtgcttctggtagtacgactgttccgctgcccggatgcgaccatagcggcattcttcctcaagggctcccccgagggacacagcgagttcagttacggtcggtgcgccatcacgttgggcaatccggttgatgacaatgcggatgacaatggatgccatcacatcagggttcatcatctggaaagcgccgatggccacatgcttgcgccggaccttcgtgacttggtgttcgatccagttggagatcgccgtggagagcagcggaacgagggtcccgaggagaggcttggcgacactgttgctggagaactcgccccggtcttgagcacgctcgaaggcatcgcggaaacgatcttcgcccagtgtgtaggcttcgtgttcaagctggagttgctcagcggccagctcagggccatagatcatggacagcgcgttgaaggcttcggcagaggtgatctcgctgaagtcttgacgttcaggcagttgaaacatctttaagatctctataagaagaatgaatctaataggaatggtctattagtcttctctgagaggtcctaaagagatctttaaggaacggccctcagagtgtcatagccacagtgagggtttttaaatccgtgccttagcgtgttgcggtgatacgccctacaatgtcgtcgatcttgtagataaactctttgatttcgcgttgatcctcgatggccttgatgcgacccttgatgaccgccagttcggggctgttgaagtacatgaatcgacaccggctgtgtgggtgcagcgccttgtgttggcgataaaggttgtcttggatggtctcggcggtctcgtagagatggcccagatcgtcaaccgggtgagaaatttgtgtgactttgaggaacctttcggaaacctcgtaggtcagactctgtacatgccgcccacatgggccgaacccggtagtaaactcgaccgctaccggatcgggaaaattagggaccatggagaggaacttaatggaccggcatgtttccaatgacttgagggacatttagaaccctccccggtagcagcgggtgaagtcgccccggtcgctgtagaacagtgcgtggcgcgcttcgatctcgtcagggtaagcaacagcacggaccagaacctcagggtgcttagcggagccgtaaagggtccccatgaccgtgtgcttactatccgggttgcgcatcgtcgctcccaatgcagcagccttttccgccgaaatccgggcattaaaaaggccctttcgggccggttggtagtttgtatggatcacttcagttcactccaatggacaagcagattccggtcgccctcgatcactggcaacccgtagtgcaatgttgttttgccgaggaacagcattccccagcctgtaaggttctgctccaccttgacgggcggcacaaagggtcccctatggaccatcgttccacctcccttgaggtcgtcattgagcgcgaccaccagagtaacgtctgagtcttggtcgttgtgccaatggcctcgtggagtctctgagggcttatagagggccgcttggacgctcgtcaggttgtccggctcaaggttcaacagcgccttggtataggccagtcctgcgtcatgccagaacgaacggaaaacctcgaagaacaccggatgttcctgttgtaggacgacctctggaatctgggcttccaagggttcctcaaggttcggcacaaaggggaacttggcgacctcgtggagaatgtcacggcagtaagctgggtgcaggtacgccacggagtaaacccccggcgcatggcagaccacacagtcctcaaggaactccgcgaagtcatcgcgcgcgagcacgtcagcagggcagaccccgccattctcctcgctgtaccgggccatctctttgagagccccgaggtgttgctttagcaacggatggtacttgtccgcgctggcgatgcccgtggtcgccttggtaaatactcgactcatgctgtaagcccctgtgtggtgccgtagaggaacgcttcacgggacagcttgaatgacccatggggcagccgcgcaccgtccttgtaggccatcgcaaggaagcccttgacgcctaaccagttgcggacgtagcgaccgaggaacgtgacccctcccggtgtacggaaagagtgggtcgccccgatgcgcttgaggtactcacggcgcttgaccgcctcggcctcccggcgtgcatcctcggcagcatcctcaagttctttaatgacaacctgacgaaaggtcttgtaagggtgttcggccttggtgtagagttcggcgctcaactgggagaacgcacgttccagatgggcaggccacacgaacatggcttgcaggatcaagtggcccacgtcttgaccgttcccagcgaggaactcataggtgaactgaccaaccgatccttcgaccggcttgatgcagacacgcaaccagcgttgctcatgcttgttggtgacatagtgctgaagaccgtcagtcaatgcagtgtccatcgcttcaatgattttggcggcgactgtgttggacacgaagttggtccggttgtagcgttgcggatggatcatgatgtactactcatggttggtgatgtgttcccgatgggtcctcaatgggaagacccagcagcgaatcatgtcactcgtcttcttgcgttgcctcgtcgaaccagcgggagaacagggattcaagcccggtcagtgagccgtagtccgcaatgacatcctcagcggagttcccgtagaccaaccagaacttgccgacccgttcccatgttggttcctgacccgctcgaaccctgtagataaccacatggtcctcatcggtcgccatacaggcatccatcgcggtgacaacatcgtttgtgatgtcgcactcgaagtcctcgccgctattgatgcggaaggcgtaaccagcctctttgacagcgttcaacagcctgcgcaacactcggcgttccccgaggattcgtttggcagcgcccggatacttggccttgatttgttcgttggtcagtttcatgtgtgtagcctcgtggtttgttcccaatgagccctcaaagaaggcccatcagcgaatcgtcacgccagcttggagaggaacacgtaatattgccgacccttacttagcgagttacgtgcggatggtctgaaatgcatcgccgtggaccattcgtggagttcttcggcttggctcaccgacagtgagtgtgggtcttggccaaacttcataccgtccgcttccaacacatggattatgtggtaatgcaggcttaggcgtttgttaatcatcgcggatactccccggactccagcagttgccgtgcagcttccttgacgatgcaggtgttacagcttggcgaccagtagagagtccccttaggagcgtccgcatagaccgtctgagtctttgtccagcccacaaggtagcgaacgtcaatctggtcccactggctcaggatggtgcatgtgttcagatgctcgtcaccttcctcaagggctttcgccatcttggcccagtaggatttagtgaagctgcctcgaaccctgttgaggacttcagccgtgcagaactggccccagtagatacgatggcgttccatgccggtgagttcctttgcgcagtccatgtaccagtgacgggtcttgaacatctgacctttgatctctacttcttcgaccttgagttgtgtaagggccattgcgtgttgctccaattgattatcgagttgttcccctatgggacaccgttaagatgcccataagtggatgccctcaggtttaacgtacctcgtgcggctcgtggtgtgcagcggagcacaatttgatagcgtccttgatgtacccaaggccacctctgaagatcatccctgttgatccctcacggacccagtaagggccattccagccaccttggcgacccactgcgtactcaaggccacggtgttcaatgtcaaccgagaagtgcgccagagtgtgatggttctggatatcttcagcctcattacagacccacaggcattgcaggtcagctaccttcaattcattcagtttcattaccgcattccccgttgttgaagtgatgcccattggcgctcatggcgtgctttacgcaatattgaaactcggtgaccgcctgcacatactggtcgggaccgaatgacttctgcgagaacccgtaagtaaccagatagcgaccgctgggcttctttgataggtagaccgtgaactgcccaagctcgtcgtgtgatgcgatagtttgcatggtgttgctccttgagttgttcccctaagggacaccgttagatgcccttaagtggatgccctcagtagccagcccatgccctcagttcctgttcgttcaggaagggccatggatgaatcttgccgttctcaatggtccagatctcaaggtgaccctcgaagttcgtgccatggcagtagtaccaatcatgctgtttagcccaagtcacgacttccattgtcatgttgttgtagcgggacttcctgttgatgtcctgaataaagccagtggctcgcttgataagcttaaacatggtgttgctcccgtgttgagttgttcccaatgagccctcagagaaggcccatcagtgaatcactcgtggtctttcgtcttctgctctaacaggtcagccttagtgcggtgccagaccgccttgaggaccctgtagtgcgtcagcgtgttatccacttcgtcccgcagcttttcccacatgggatggctgtgagggccttcaaagcgcccaaaggttgacttagcggattggtgagcatcctttgcggccttgatgcgtactgccagatcgtcaagtgcgtcctgtagggctttggttcttgtactcatggtcagcttccttagctgttgtgttgcggtgtggatacggacatgaactctcctttggctcgtgctcaatgcttgggttacacgagagttcattaccctattcactactgccttgcatcctctcccgaccagccgcatccaatgcgttcggagtgcttgaggctaccaagcaaggcaggtgttacattccaagttgttaaagagcggttgtttcagtgcgtacctctcccgtgcttcgtcctgaggacagcctgaagggtagcgcttagcgtctggaagaccgctattgttctgcgctttcgtagaccaacctactcgtgacatccgttcggttaatcgttgttgatgttgcgtattctacagcgtttgtacatcgtgtcaagcgtttgtttctcagcagtctttagggtaactcgaagtattgcccgacccagactgtgccctgtaggtcctcggtgtcagtccctttggtcatctcaatgagacctcagaggccaaggccgaagaccgtggcgatcaactcagtgtttgccgttgatgggagccattagacaccatgaattgaggcatgtctacctgtttattcatccagtgtcctatggattctcaatggtccctcaatggttaacgaaacgggcgcacacgcggataacctatagaccctcagtggtcaatactggatagaacaacagcattgtagccaagaacctgaccaatcgatcaaagagcacctctgaaagccttatagatcaagggcttgaggctattagcaacgatagactactaccctatgccatggcctacctttggccctaacgtgtccctgagagcctctgaggagcttgtagagggtcttaccgttcgtctggttgggttcattaggagcatggcccagtggtgagcattaggagccctcagtggttacccaaggagcccattagggacacaacagatagagacagacggagacatagagattccctatgaaccctctaagaacccatagcgaatactcattgtacacctcatgcctatcggcccataatgatccccatgagatgcccttgagggatcaggcaggtatctcaacgagcccatgtggggatgaggtggcttagagtagactgagagggcccctacgggggtaatctcggtgtctgtccatgagaggtgctctctcagatttttctctcagattctcaaagagtcccattaggataccctaacgatccccagagtcaataccttctatcggttatcctaacgaataccctgaggaccagtaagaccagtcattagggtgttcattaagggttgctctcacagctcaatgaggtagtgtgctaacactgccgaaattgagcctcgcgtctgtcaatcagcgcacccaccagatgcaacgcagatcagggttgaggcccatgacatgacttcggacccttgagcgaagccagaggcaacgaggataaggccgagcagcttgtaggtggaacgagagagagccagccgcttcagtacgagcagcacagtggccttctctacgttcatggttactggtctcctttgatgggtgatggctattgccattaacacctgacctaagagagcgagggtcgatgccttcggaggtcatgatgctcatgaggcccgaaggagatctctaagctttaatcacttaggaccccctacggtagccatagtgagggtttttaaattcgtgctgataatgaccagatatccctatccggtcacactttaccagcccatgaagttgctcatgctgccgtcatcctcgaactgaatcgtgagggaatcagccatggacatctgccgggtttcctcccagccgctcatagcgttctcaaggtggctctcaaggaactcctgaagcatctcctgctcgccggtcacgctgttgcgctccatggcctctacgaagaactgcacgccgattgcaagggcatccagacggtcatcgtgagcaaggctgcctctctcccgagtgatgcgtgtaagctggtagaggaggctgtaggaggtgtcagtggttccgtcgttgttcagagcggtccggtagtccttgtcgatgagggcctcactgagtaccagcttgtgagagcccaatacaggctccagaacgtcgcagatgcgtagttccttctgacccttggacttgacctcagtgacagcgcacgggtaggtggcggcgatcacagggctaatcagcttgacgtacataccatcaccgaagttgccttcaatgaccacctcgttgaccttgtagatcttggcgatgttcgcaagggcttgcagggtcgtgtcctcatagccaccacggaagcccccagcgtccatcacgaagatgtagccgttgagctggtacaggactgcgtagccggtctcatccttaccacggcccgaggggtcgatgacgaggatcttctgggcgtactcagccatggcctgaccgacagactcatagcgatggaagcggtcacccttgaggcccaccagaggaacccctttgacctcgttagcggcgtttggaagccatgtgagtagggttggacccttcgagagatcaaacgaccccacgatgaagtcacgcagcttgagagggtacttctccatgtcggagaggttcgggttgagcatgaactggagagcgaagccgcccttgccatacgacagttcccgttcattcaggtcagcgttgtcgaatcgcacagggtctgtaggagcccagtaaagccttgggtcatcttcgagttccttggcgagcataggagccagccttgggccgtacgagtcgagatctgtttggtccttagggtatctcgcaggccagatcgtagtgacgtagccacggccttccagctcgcggtagagggtcatctcggtctgaggggtgcccagatagatgatcgttccgcccggcttcaggatcgcgtcgaattccttaacgagttcgccaaggtgatcgcgagcggcctgagttccagagttgttcgggacctccacgtcatccgcaatgaggatgtcagcacgggaacccgtaagctgcccggtgatacctacagatttcactgagggtgagtggtcgggttttgctggtcccacgtcgaacgccagagcggagtcacgttgtccgacccgaggtttcagctcgtgcaggaacaggagcaggtcgatgatgcgcttgatgaagatactgttggcgtctgcccgctctttggaagcggacacgatcatgaacttgaggtcgggattgttccacaacttccacacgacgaaggcgcatgtgatgaaggacttaccgatacctcgaaatgcttgaaggataaagcggcgttggtcgccactggaaagttttgcagccatgtcgatctgacacttggtcggtttgggtagattgagtgctctccacagtacgaacaggaatagaacgaatgactgtttgatccttttgagatcatcagtcggtttagtcacttgtgcctccagatgtcataagccagacacagtagaaggcccagtgtgcaagccattacgaagaaacaaaggaacatcagagccaagttttcctcgtcgcttattgggccggttggggtacttgccagaatcaacatactcgtgacaatcattgcgttcattgcttacctccttgaagtgctcttacagttccttgcagtgcctttacttgggcgtctgctcgctgggcttgctcgataaggaatccagcagtgtctgggtgtagttcggctcgaccatcagtgattgatcgaccgtcacttgtgatgcaggacacgatggaatcgttgagcttgacttgcagccggataccacggctacgcagatcagcaatagtccgatcagcaagttccttacttttcgcaacatgcgtttgccaagcggcactttgggcgttgagggcgatttgggttgtttcacgttgtacctccagttgtcgagtcgcggcgagcatctccgcttggtgggtaatggtcagttcattcgttgcatctttgtgacccttggcgtacgtcaggccgagacctgccgaaaccaaaaggccccagatgacgaactcttttaggttcaacataaggggcctcctttagtggcgagcagcggaaccgtaaagttcctcgtcggttaactcggggacttcatcgagagccaatgcgagatctcccagaagggactcgtcaggcttcaacttagcgatggtgaacttgtggcgctcaaggtacttaccgatggcgttgtacagttgaggaccacgccgagcatcgtcacgcaggtcagccagaagttgacgacccaagtcggtgtcgattgcctccagcaacttttccagcacgttatcactcatggtgggtctcctttgttcttgcgcttctcatccatgactgtcttgaagaccagcacgatggtttgcactactgtgtagataatgacggttgcgtagaaccagtcactgagggtcatgcctgctacttggcttgccacttcggcaccagccccagcagcgataggagcggcgcgaaccactccattcgtgaagtcgatctcaagggaagttgccattacgacatcgccttgatctgcacacgcagactcttagccagagagatctcttcgggtgtcgccaagcccaacatgatgtccggcatcagcttgtccaattcggactgtaggtcgtagatggtcacatcaggacggacgaattcggcaacttcaccatactcaccagcctcagcggcctcgaaaagaacccgaccgtgctcctctacgtcatctggacgagcagagaacgggacatatcccagatccttgaggtgctcgaaaagaacttgcagggtaatgaagccctctgcgtctcgcacaggctcctttgcgtctaatacattgatgttcattgtgtcctccataaagaggccccgaagggcctttaagcaactcgcaggtacagactgacgcccgtactggttccgtatcccatggatctccaagtaccaccaccaaccgccccgccgttgttcttgtcaacgtctgagtaataaaggctggcaccagacatagagttaccgggtgcgttatgtgaaccagcagtgctacggcagaatgcataagttccgatggcaccagcggacccgtttgatgcgagccagctattgaagttagcgttggtgacaagcgcccggttattaccgtcactggccatgatgtttaggtcagtaccattcaaccaaagggcaagcgcataatacccatcccgcaggaaggtataagcaggcggggagttgtctgtagtacgagcaacaaagtgggaattgtcgtacatggcagagctaataggtacgccattgcgcgtagtaacgcaccggccagagttgtaaataccaccttgagtttgaatctcgcgcccattagggaactcaacggcaccattcgagcctctaatgatgatcgactcggttttaccggccacacggatgttgaggttgttgttgtagtcgccgtagagcaatgcccgctcgcttccgtcgaagttacgcatccagaagtgggtgttggttgcattgctccctgatggggagacactgaagacatcgatggccttggcctgcccggtggcgttgagtgcccctgtgacatccaaaccgcccttagcggaaaccttaccgagaacttcaagggtctggcccagcgacacagtaccccagacggacatagcgcctcggacgttgaaggttgcagcccggatgttcacaacgtcagcggaacgaccgtagaggtcatcagcgagcatggtgttgaacgagagttgataaccgtcattccagatgattcgctttgggtcgccctcaacggatctcagggtccccatgaattggttggcgttacccagcttattcgcctcggtagttgcccggtcggcctcagtcttagcggtcgtcgcagaaccagcagcagcgctcgcagaaccagacgccgcagtagcagaaccagcagcagccccagcactcgcagcagccttccggctgtagtgataggacgaatagaggccgttgtagaccactgtgtcctcaacctgagaggcccagattctggagttattctcggacgtggacgcggcctgttgggattggcctgcctgattcttaaaggtctctgcctgattccggtattgcagtgagaggtcccgagcgtcctgagaggccccagcagcggtcacagaggccgaacggtactggtccgcctgattggcagactgggcggctgcctgtgcctgattgagcgcagagcctgcccattgcttctgttggcgcaggttgacagcatcaccatcttcgatggcatctgcgaggttcacaatgcggcgcgcacgggcgtcgaggttgccatcgttgttcacgccgattgtgtcagcggtcaggtcacgggcttcctcagcgatgtgcagggattgcacgctggagatgttgagatcgtaggcccgcaaaatggaaccgtcagcgaagtccacgaggcgctccgaagcggaggtaacccggcgaatctcgatgagatcaaagccatcagcagtgccccaagcgcgggtcgtagttatctgcgttgcggtgacgaaacgataatcggtgttcaggacaagttctctccgagttgccccgatgagagtcacaacgatgaacttacgagcgagatactcgaaggggatcgtaaagtctctgagggaactattcagagtccacgtccgcaccgttttgggtgtggtagccatagagtctccttaataaaaaagggccctcgaagtgagagcccagtagccatagtgaggggttttagcgagtgcggtattccatgccttgcgactgcatgattgccgacattgctttctgcgagatcgggtcgttagggaccaaaccacgcagcccgttatacaaaccagtcatgtaaccaagttcctgagagttccttggagaactcccccagataccatcagcgttcgcgccgacctgatagaacgacccaaggacgcccattgagggcacctgctcaaggactcggctcaagggagcctgaatgccgtcagagcgaagtgggttgtaccgggttgggtgctcacgcttggtgaactctgggccacgcgggagaatcgaggtacgcacagcagcagccgggtcgtaacccagaggagccgcgaagaagttcgccacgccgataggtgccccgatgatgttccctctggacagagcggcccagccaatcatctccttggtcattgcctgcttcaggaactccttgcggcgttcttgagcgagaccctgagcctgcacgtagcgttgagccacatagaaccccgttgcgaggcccgtggagatgacagcctgtagggccacatcgagtgcctgaccgttcttcgtggcgttgtagtagctgcgcacgagacgggcattgagggtcctcaggacgaacttcttgaactggagcgccatatgccagccagcgcccagcgccttggtgtcctgagaggacagcttgtgaggacgcaggatggtctcatcggccaccttatcgcccagtctccagaggtccatggtgcgtgggtcagcccggaaggcgttcgcatccttgatcttatagctgtcgccatccttgacgaggtgttgacggatgaggttcttgatgtctccaaactgggcctcggtgatcgacagttggttgaggcgttccttggtcatgaccttggcgggcatcccgtgggcagcgttcaccatgtccatgagggccccttgacggccagcctcgatgatgtagttggacgtctcggtgagcatccgggtgaatgggctccgagcggcaagttcctgtgtggcgaacttcagggtccctacagtctgagctacaggcccactcgaaacctgacgcaggcgatcaacgatgtcctgacggcgagggcggataacatcatccagctcccggccaaagacgatcccatgcatctccttgaggttctcaggggtgatcttcgagccccatgtggtcatctcccgcaggaatggtacgccatgcatcagcatacggacgtgcccattggtgaccatcccggcgatctcagtgaagttctgagcggccatgtaggcgttcttcgagaagaaagcgagatcgttgagggaccttgcgattgtcccaaagacaccatcaggatctctacgggctctcccggtgagcagctttacggcgctctccagtgctgtagcgtccttgtggttgcccatacgggtctggatggcgaggacctcctgtttcagcgcatcggtgttcttgccagttgcacccatgatgcccacgtcgccgttgatacgacggtcgtaagaagacatgacccgaggcacatcgaagacacggagatcgttcaccgcgaagctggaaccgtctgacagtgggacagtaacgtccgagtcgaacaggttacgggcttcaaggaaattgttgttctccgcacccacgaggttgttcagaccatcgtctatcagggagctacggttaaacttggattcgtggctgataccaaaagccttgtcgttggcgtaccgcgttacggctgccttgatggcctcgggtgtcgctaccttgccctccttctcaatggctgccttcatggctttatcaacccgagccttgacgactgggcgagcggcataggaggccaaccatgattcctgaatggcgcgctgcaaaccatcctcaccgccgaagcgacggatgtgcatagccttggctgcgtcatcatagatgtgagggacgtaggacccagcgtggcgcgtggtgtccaacaggctcaccgcttccgagttaccgaactgggcagggttctccagcatgtcctgcttgcgggtgaagtgaccattaatcacatccatcagctcacgttcttgcggggacaacttggcctgctttgccttcgtctggtcctcaatggcttcgacgacccggcgataagccaactcacgcttggacaagatgcccggctgcgtggcgtaccgagggtcctccttgagggtcttttcggtcagctcgttcagcttcccgtaggtcacatggtcctcccctcggatgcgctcaatgatgtccgaagcggttgccccaaacttgccattggtgcccgactcggtttgcaccgtggagcggaacagttgaccacctatcttgcggatggcttcgtcttctgtacggttgagcgtgtagccgatctcagcgatggccccgaggttgaacccagcagccgaacgctcaggctccagttgagccactgcgcgcagggtcttcgggttgatcgggttggacgcagagatgattgagccgtcacgcagacgcacagcgcccggttcgcccggaacgtccacaaagtcgattccatcgtgactgtcgggaacgtcatcggagttccatggcatcttggttgggtcctctccaccagcgaggcgcgcatcttcacgtgcctgtaggcgcgctgtgacgctgtagaactcgttgggttctgaagactctgcatgacgcgcaaggatgccctcaatggtgtcatcagggagatccttgagtccttcttggcgggtgtggcgttcaccgtggagacccaggatcttctcaaggtagtcatcgtcctgcacgtcatcacgcacagtcggtgtggttggctccatgccgtccaccagatctaccgaagcgttgggctcagaggactcaccgtgacgcgcaaggatcgcctcaagggcctcatcgtccatgtctgggcgagcccttacgttgctcacgccacgggcgatgtgcttgtcgaggacagcggcaaagccactccccaacacggcaccaccaacagcagcggccaagtagtgaccctcgatcccagtggtctgctcacgcagagcctcagagcccacagcgagcgccgaagtgaacgcaccctgacgcaggacacggccaccaaacgtggcagcctgagcgcccggtactgggatgtacgaggttggatcaagcggagcctgagcgacaccgcccagcaactgcgagccgataccggaatcccggatgatggcttcgttcgccatgttctccttggctaccgcaatggcgttggggagttccgctttgaccccgtgagtcctctccacaaggaactgaaacatcttcggagggatgcccgcttggcggatctgctcgtagtcgtcatcgtcccattgggcttggattggactgtagtcagccagtgggtcgtgttcctcctcacggaagaggtcgcgcagcttggcgcctccccatgagttatcaatggatgccacaacggctgggaaggtgttgcggaaccatgagtcgtcctgaggcccgttctgggcgtagtccatctcgtgaaaggtcttctgggtctggggcaatgcaccctcgctcagattgaacccttcaggtcccttggagttgccacgctcaacctgaggttgcttggtgagtccttgcgtgtatttctcgaactcaccattttgctttggggcggaaggctggtcgaaccacttcttgctcggggaatccccagcgacatccagaaggttcgccatgtagttcttgccttcctcggagatcttcgagaagtccccacgatccagagcggccaactggggagaccccaaccgaccattgccttggttgtacgccagagcggctttcaggtagtcgcccttgtaggtccccagaaggtccttggtgaggcgcgcagatgcgtcgatggacttggcagggtcgaagaagtcttcgtctgtaacgagcccgtaggcccgtccagttgccttggtgaactgacccagaccacgtggccccgtagggctcttggcgttggggttgaagctggactcgttgaagatcttcttatgcaggtagttgtagtcaacaccgtgcgcatcagcagcttcccgaatcatctggtcgtatggcgtgccacttgccagaagttttgcgtattcgtctttacggctcattggagttctccttacatgatgccaccaaaagtctgacccgctgcctgtgtagccttggcacggtcaaccccttcgcggaattcttggtttctgagtgcttcctgttgggccttgtggatcaactggagcgattgctttgtgaggacgatgcgccgcccggtcggggacgctatgttgatgtcgccggtgttctcgttgacgcttacggttgccccagcgcctgcccaagcgggagtctcaaggaggccctgaatggtgcgatcaacaatttccttaccggcctgccacgagttcacgtcctctggggaggccatgaggctgcgcttgtcgagtctcccgatgtagccggaatcttcgtcaccctcggtgaacgctaccgtgttctggttgagccactcggtgagcttttccttggcgagggtcgggttacctgtgcgctcgttgtagccgtcatagatgttccgagccatgcgctgaaggggtccggggatggacgacaggtccttgttggccgagtcattcatcaggttcatccattcctcattgcgaaacttctgttcctcggttgacagacccttcttggacttctgggcatccacgagaacctgaggctcgatgccgctctcggccatgtccttcagttgctcaaggaagtctgcttgttccccgaagacgttcccgattacagcggagttcgtcacataggccctctggagttcctgtaggcgtggcatgtcaccaacctgacctgacctcaaggcacctgcccactcgcgctgtgcgtccgtaatgagggtcttgtagtaggtctggaacggcccaccgtcatagtcagcgttgaggtactgggcgcgcatagcgtcctgcttctcctcggacaggccagagttcttgatacggtccatggtgcgggccgcgaacgttggtccatcggactccttgaattccccagtgtcaggcgttacggcttgatccttggggttcactgggacgttctcaccggcgattcgcttggcatacgcctgctccatgacatccatccggttgtccgactgggcagcctgcttgaggcccgcagcgcgtctctcggagtcctcacggacacgagtcagcaacgtctgttcggcgttaatgagcatctgcttttgaggcgtcatctcatcaccgacctgcacccatgcgttctccgtgcggaacttctggatcatcgtcatcccgatagccgggtcgtcttggttgatcgcctgagtgatccccagagagaacgtcctgaagcggtctgagtccttcttgtaggagttctcattggccttgacgatggcgttgtccaagacatccgcaccgaagaggtcctcgaccttgcgggcacctccaaggacattaatggactggccgcgcaggttctggatcagattggcaccaccgggcttggactgagcgtccgtcaccagttgggtaagcgcggtcatcacggactggtcagtagggaactgtcgggtctcgatgccatggttgaagtaggctgcgatctgaccgccaccagtgggcgtcatcatcacctcagggtcatccagaagaggccccaagtcgccccgagcgttgaccgctgtttgggactgataccacttcgaccgacgtgtatcgtgggcatcgaagagagcggcattccgctgcacgatgtcaccgttgaaaccacgctgatactcagggtcgttctccacgaaacccgaggattccgcataggacttcgctgcgtccgttaggcgctgttgccggtattcagccagccacgcgcggtccttgttgtcgaactcacccgagttgatcttggtctggatctcactgtccacgtcataggcagcagagcgccccgacttgtagcgcagcatgttcattgcatcagggtcgtcctgatactgaagggtgcccgcagagatggcctcacggatctggtcgggcttcagcttgcggatgatctcgtcagagcgagcctcagcggatttctggctggcttcctgataggccccataggcattggtgccagcctttacgaagtcgttcatggccgcagcgaatccgttagaacccacaggggcccgttgagcggacgcttggaaccctacggtccccactgaggaattgagccgaccgctcttttgcatctgagcgccgtctactgcacgctcgattgagttagccattacttagtacctcctgccgctgtaccgttggattgagacccaccacctccagacttcgccatcgagctacccattgcgtacccattggcacccgcagagatgatccccaaggcgttcgataggccgctggtcttgatgacctgagcctgacccttgagggccgacttggtgttctcgacgttggcgatctggttcgcaaagatggattggtagtcgcggtgatagttatccaccacgtccatgcgcgcagccgacgattcgttctcgacgctgttctgtatgcgtgccatggagttccctgagagacctgattcaccgatggcggtgcggatggtcccccggttacgggtcgcctgtaggttgatctcggtgagttgcttacgggcttcctcttgcttgtcctgagcggacaggttgaggttggcgttagccatgttggtttgcttgacctgctcgcgggccgttcggcgctgggcgtcttcagcggcaccttcagcctttgccttctcagaggcacccatagcggcaccggctacagccacaacggccataccgatacttactggttcgcacatagcgattctcctatagccagaattgacggaatgcaaatccagcctgggacatggtgatgccctcagagaaggtggcaccgagagactccagcagacggatatgcggtttgttgttgacagagacgaagttagttagggccttgttattcggcacatgatccttgatgtcctccaagtgccctttgagcagcctgtagaacctcatgcgttgcgccttggtcagtcgatccacaacagtggtcgtcacgaaccagaggcagtccttggacccacctacagccaaaaccaaagagcccaccttgatcgcacgagtggtctcgtcgaggcaggcgggcagggtatcgcgtgggtcacgcccagccgtgtgggaatggaactcgtcaaggtcgttcttcgagaggttccctgaggcttcctcaaggtctcgtttagttgcttgtgtgataatcatgaaaacccccatagggtgccatagtgagggtttttgaggcccccacttgacaactgttagataccggaagatcggcggatgtagttaccctcccagccgcacccgatcacgttgaggggattcggtgtatcgctggtgatggtcactcgttgattgagcgcgttacctgttaccgggaacttgtattgacctgtgcccagcgacagctcgcccagagtaataccctgaccaaggcgaccacctgacataacgtaaacgtactcagttgagccgttgctcacgttgatctcaaaggaacccgattgctcatagttgagccatgcgcggcgaagttgcagccgaccaatgtcctcagtggaagtcgagccatcatccgcagtctgcttgatgaggaacttcgagaactcatattggaaggtgtattgcttaccgataaccagacgctcgcctgcacggttgcccgtgaagtacaacttagatgaactggtccatggtccttggaactctgtgacgacacctttctggtccagagcgtagaacaccgcgtctgctcccggtactccgccatacacactggtgagatccaactcggttaagttggtgtcgatgttgtacgcgccgagtatcacttcccgcttcatgtccatataggcccggtaaggctcaatggcgaagtcgatagtgtgctgggtgaactccatccgttccaacatgatcccctcaggtcgttcgatcagcaggaacatataggacccgatggcagccgctgcgaggatcttggtgttttccccaaagttccaatgtgagaacgactgttgctgtaggacctcatcgagatacaggaacttatagatgtacacattgcccggctcaccgtccgagaggatcgacacgaagttctcagtgcctgacccatggatagcgtggatggtgttcggcaagtagctcggaacgtgcgcagagacatcctcagcggacttcacgtcagagacatcctgaatcgcgtagtaccgcttgagggacgtaaaggatgcccgtggagcactgaagtaaacacctcggccaatgccgtagggtcttgctccatcgctcacgtcaaactctgttgtcaggtccagctcaatcgtcttggacgacaggatgccgttggacgacagaacgaactgggcttgatcggaccatagcaaaagctgttccgagaacgggaccgcgtacttcagaatcgagatgcggttatggctgatagctacgtcaatcgggtcgtcatcactcagggtcgctacggacgctgggaagaagttgaagtaacgtgaagtcctcgacatgatgacgttctcgcccgagaggaaacccaagcggttcctgaagaagaacacgtcattgatcgttgagtccacgaaggacggcatagggttcgtatcgtcgtcaccacaggcccgaccgtcccaacttaggacagtccacgagaaggaaccatcagcctgacgcacgagggcatgcggcatggttgccccgttgaaccctgagatcatcttgggcttggcggtttccttccagaccttgcccactgcgtcatagacgacccagtagttgtcccctgagcgggcgctctccccggtgatctcaacgatgtacccagagggtgcgttagctggcagcttgttaaacgactgcacctgatagatgaaggcattcagcagcgtgtcagcgtaaccatcgcgggtcccgatagagcttatgttggtcccgttcggggcggtgatgaggatgtagccagtgcctgccgtgaagttccaaccagagggcccgagcgccgctgtgagttgtgctgtgagttgctcagcgatccatgtggcgtctgtcatgtccacttggttcatgcccgcatagggctcacccgaagggaccttctcggcggaaccgttgggcatcttcacggatgcgaaggtgttcccgttgatgaggaccgaaagggtccgaccgtactgaccaccccgtacgttcacgagggccctctggagcagcgcagggtaacccgaagccgtcagtgtcgagttcatctggacggtcttggagcggttcacaacgaacgtgtagtcagccactgtgatgacccgaaggtccgtccgtgggttcgcacagttcgcgtagccgttgtatccgttgaccgcgtagttgttacctttgaggtcccaaacgtagacacctgagccactgaaggccagatagtattgctccttggcgtcccggttgacgaggtggaccagaggcttggccccgagatacccaacgttctggagacgcttgaggaacgtgctcggcggtcgcttctgtagaccctgggtctccgacgaccagccattgatttgaacctcgccttggttggagaaccgcaggatgttcggttgctgcgagatacctcccttgaggttcttggtggattgcgaaacgagtcccataggccctccttatcgtgagatgagcccgccaacgaacgagtcgccgtcaagcatgttgaaaccgccgtagtccagctcgtattcctgaatggcctgccacgcttctttctcctgctcctgtagggcaccctcaagttccccggctccgaagaacctgatctgaaacctgcgagacgccttagcgacgatgtaagagcggaagcactcaggcatctcgccgtaggtcttcaggcggatgagatcgactgtgatatccccggcgaagatgtcggtcttggtcgtccggtcgtagacgtaaccgccccggttgatgaacgctgtaccgcccgatgtggtgatgcgcaggtagtcgctcatgtattcgatgaggccactaaaggtgtccggggagagcgttgcgccttcctcaatgttgaacgtccagcccttcgactggatctcacggttgacctgattgaggatgcggcgacagttcgctacgtctgcgttggcgtcaccctcaagggaactcacaggggactcaccgatggccgcgagcatgtcgttaatggccgcaagttcgtcatctgtttctaatgttgcttcgtatgaacgcatggggttctcctaaacgaaaaacccctcaaagccctgtgagaggccctaaggggtttgtggtgttacttagacggctggagtgaagaccagcgcaccagcggcttcaggacgcaggccaccgtgacccatggcgtacttgccaatgatctggtcggcttggaactcagcacgacgagcgcgctccagtgccatgtccttcagcttcacagtgcccacagcggagcggtgattgaacaggccaacaacgttgttctgagcaaccttgtcatcgccggtcgcggtcagtgggaagatgtgcttctggtttgcaccgtcagcatcagtacctgcaccaccaacgaccaagtgaggaacttcgatgacttcgaagcccatgacgttgcggatgttgccggtctctgggtcgatcagtgccgagtagttggcagcgttcggcatcagagcggacaggatcgcgctgtagtcgtccggcgaggtgtagaaacgacgatcaccagcagggacgtagttcttggtcatcttgccgcgagcgagggtcaggcccttcaggatcgcacggccacgggcttcaacgtcgatcaggtcagcagcagcgccgatgttcagaacgacagcagtacccagaccagcgatgttctcgttggaagcggctggcaggttgcacagcttcgccatctcagccagaacggcaccgtcagcagcgatagccagagcctcacccagttgagccgagtattcagcgcgaacgtcgtagtgggtcatggcgtcttcgatgtcgtagatcagcacgtcagaagtcagcagaccgtcgatggtgatgaccttctcggaatgcttgatgtccttgcgcttgtcatcgaggttctcgccgggtgccaagtagtaacccttggtgcggcccatgaccgggaagcttgcagacttgccgttctggatggtgcggaccatgtgtttgtccatggtgaccgaacggcgagcgaacgcagtcaggacttcaccaccgaacaccttaaggaacattgccagcttgtcggctgcgctttgacctttgccttggttggcaccaatttgttgaccgccagttgcatttgccatatatgagactccttctattagattcattgggacacacgaagtcctccaaactgaattggtggaacttcatgtagccatagtgagggtttttaaatctggtggattaccagttggacttgtaaacgcgggcctcaacggctttgcgataacttgggtcgttctgataacgcgggtcggacattgcagcgaccatctcgcgctgggaggcataaccctcaggacccttagaggtcgccttgggagccgaagcgcgcttgttgacggtacgctctggggccttgccgaacttcttcgagcgcgactgcatacccagattgatgatggtcttaacggctgccagatcctgacggctgatagcttcttcgagagcaactacagcgtctggggagttcgcagtgaggtgagcaagaacctgttggaacttctcaggaccaccggcgtattgttggatcttcgcaacgtacttctcagagacggcctcttggcctgcaatgaaagaacgcacgaaaccacggctgtagccaaccgcttcgagagccttcagggaagcctcagagagggccccatcgttggtctcgtagtcggcctcaatggcgtctgcctgttcaggcgtcagacctgccttaatggcttgggcgcgcagttgctggaaaccttctgcgtactcatcgatctccttagaggcgttgaccagttcagcgtcaggctcgccaagtggggcgaagtcatcggattcagcgtcatcgttgacaccatcctgttcgccttcttcggagccttcttcttgttcttctgcgccttcttccagattggactcttcgccctcttctgggacctcggagaactcgatggaatcatcaccatcacggacggaagttgggagggccaacatattctgctcgtgttcggtaatgttgttcgaggacattactgcaccattgacaccgaactcggcgtatacatcagtcattgaaagtctcctgtataaaatgagggccacacactcaaagtccgcccgtaggtttccttaatcttgtgtgtagccatagtgagggttttaaacttgagcgccgattgcacccggctcaacaccaacagtgtccattgcggcactcatggcttcgggacttgcggtcgcctgagcggccatcccttgacccagaccagcagcagcattgagaccgccctgttggagcatctcacgggactgcgcttgggccttctcggactcggtgagcaacagcccacttgtatccagaccaatcgcattggcgagcctgagcttgatgttgctcatgttgaggtctgcatcaccttgtagctgcgccacgttcgccatagaggacaggaactggttcagcttgtcgaggtcctgaccacggcccagcgcttccacgccagtgctcacggtcggctcaacggcttccttgggcatgtcagggatctgcgaggtcgcctgaagctggttcaacaggatgcggacgataggcaactggagttcctgcgagaggatcgaatagacgcccccaagggtgtcctccagttcagacgccacataccgaatctcttcggctgtaacgcgttcaccttgtcgctgcactgcactgttcagcataaagacgtaactcagacgcccctcaatggcatcagccacggacttagccactgtgaagtcagcggtcttttccagttgcaggaactcaatgtcgtccttgcggcctgccacgaagtcacccgtctgggccttgaccaagcggcgaacctgagtgaccccgttagggttcaccagaccgatcaccttcgaggcgatcatcgagaacttaatcatggcctcgtagaggttctcaagggacgtgaggtcacccagatactcctcaacgtggctccgaccatagtgctcgccgtcccgcttggtccaccttacggcgatccatgggcaggcatccacagggtactgaccgtcagtgccatccacttctgcgccattgacttcctgatagctcaggtactcaccggactcatcgtcgagatagacgtgggtgtacacttcgatttcctgctcgggcttggcctcttggccttgcgtgtcaatgctgttacggacatcctctgggagagccgcataggccaccttgtcgagggtcacgatttgcaggacattcccgaaggcgtctcgctggacaacgtggttgtgcaacgtgtagagcttcatcgggttgtagcttgaggaacttgcgtcaggcggcgggaggtaaagcaaccccgagcccgatagagccaactgccggatcaactcaaagagcgtcacgcggtagctgttggcttccatgtaggacatcaggattcgctcaaccatacccagaccctgctcaacaacagccagttgcgacgggtcagcgaccagttgctttgcctgccattcggacaccttcagcttcatccacgtttgcaacgggaacagagcgagcatcaccttggcggacaggttgttgagaccacgggccccgataccctgccacggagttgtatagtccgtagaggcgttgtcggagtctttggggaacagggaggggatagtgaccttggcgcagttctccgctcgggtctcgtagggaacgcggtcgttcttcagccgttcatagacggcctttgcgccttcctcagcgaggccctctcgggcggtagttgccatgggtcacctccttaaatgttgatgccagtaccagcggagcgggcaacttgcagaccgcgtttacctttcgcacgggcggccttcttggcagcctcggtgtcgccatcgtcttcaccactggtgtcctcagtgggggcctcaacggttgcagcagcgacaggcgtaggagcagcggcttggactggagcagcagcttgttcgactacctttggcttgtcgtcatcaccacccaacaggccgccaccgatggttgactttgagacgaccttcgtgaccttcttgacgaccttcttaattttcttccccatggggttcctccttcagtttcagatagttgatctcatagcggcctacgcctaagcgcttggtatacgccatgaccttgtacagactcgcccgagcgattccggcgagttctctttggagccgcaatgcggtccccgttggggcctcagggaagaccatccgccactggacacctaagaggggccctacatggctgtcgtcgtcatcagtggctacagcgaacgctacaagcttcccagaggcgtccctaacgaccagctcgacccacgcctcaagatcctcagtggcctcgcagatggcctcgtaggcttcctcgtgggagcgctgcatggtcatctcggggaacatctgaatgatctctgtgaggcgctcacggaatacggcttggtcgccttgggtacgccactgcgttatcacttggtgaccttcttcacggcccgcttaacggaactggtagaggtctttttggtggatgtgaagccggtatctttggcgactgccgaaccgctcccatcacccttgtcgctggccgaagaatccttctcgactgtcagaccatccacgccagattcagtggattgatcgtcctcggatgcgccgaagtccacgcctttaggttcctcgatgagaaccggctcgggtgccttcagtgcatcagggttggtcttcggagtcttgactttggatttgaaacacatggccttagtcctcctgtctttgacggtcctgcatcagctcaacgatctcagtggcagcattacagccgtcaaggaaaccgaggatgtagccttccgaatacccagccttccgcaggtcatccagcacgccagtggcgagcagataggattgactgagacggactgagaggtactcggcagaggccaacgggatgtcagggatatcgtcggggttttgaatgtggtgtttaacgatctggagcatgagccctccttaaataacgaagggtcccaactgagagaaaatcagttagaacccctataggtagccatagtgagggtttttagcggagcatcgctgccatacccacgcaccagatagcgaaggccagatagcccatcacgctggttgccagaggattggcttgcgagtctcgaagttgaagtcagaggcgcgcaggatgcgagcaacttgagcttgaaccttgaggtcctcttcggacatgccttgcttggcagcgagggagaccatgcagtcccagagggtttcagcggtcggacccagcggcccatctttggcctcagagagtgtcatcgaggtccaataaggaacttcctcacccttgcgtggcccggacttcatcactttcgtggcctcgtagaagaactctggggactcaaggaacgccttagcggtctccttgccgatccccggaatcccaccgtagccgtcagtgacatcgcccatcattgtctgaagcatgtggaacttgtcggcagttgcttcgtcgttcttcacgagttccatctgggttaaccagaagaagtaaccggggaccgtgttgaagtccttgtcacaactcacggagatgatgcggtcgcaaccggccaactcaggcttggtcatcaagatcccgcagacatcatcgccttccactccgtcccacttaaaggaccgctcaggaccgaagtgatccatgatgccctcgcagaacgctgggtatccgacaggcttacgcttgcccttgcggttggccttgtaggaccagaggactttcttacgccagttgtcctcacccgagatgatgcacaagtcaacgaactcatagcggtcttcggtcaacttgaacttgcgcttcagttgcccagcaatatccgctttgatggacttgatggtcccgaacagaatctgtcgagctttgttgtgatcgcagttaagcgtccagacatcaccgccccaatctacttcctcttcagccgcagacatcgcagagaagatcaggtagtccatatcgagggccaaacctactttcagaagtttgctcacacggcacctccatgttctgcgaggaactgttggcccttggtcgtcagagaccagaaccccatgttctttccagcagtggagaggcacgagatgtgcccacggcttgatgcctcgttgaccagcgcaatgcgggaccgcacgaagtcggcttgatatgcacgggcttgcttcttgatctcccagagaacttttaggtactcgttcattgggtcaccgtgaatcgcttacacagcgccgtacaggctttgtcctcaggatgcagaccgcacacttcgggcttgcctttattgacccgtggagttaccacgcagagagccggggcgaagtccttgaagccagacccaccgcactccttcataaccaactcacggacttgctttgcgctgtccttaaggaggaacgtcaggagaccatcagcgcctttctgttcgtgaagggccagcatggttttcgcaactgcaactccaccgggagcagcatcagtagggttcgctacagtgtcagcggctgccttgagaacttcctgaagatcattgagcatctcgtcgttgaagactgcgcggaagttcagggtgatgctcacgttaaaactcttggacataggtcctcctattagtggcactcgcgccatgtgtcaccgattttgaagtcggtatccagtacgcagcggaattggaatgattcgccaacctcacggatggcttgttgggaaacctgagcgatcagctctgcgatctctggggttcttgcggctatctgaagttcgtcgtgaacccaagccatgaagcagaagtcaccagcggacccgtcatctttgaaccagccgtgatacaggccatggtcctccatgagaatcctttcgacggccacaacccacttcttgcagaccagcgcaccggctgactgaaggagcgtattgagtgccgagtgggtcgagcggacgtgaaccttgcggccatccaagcctttgatccagcggcgtttccacttgacgtcgaagcgcttggtgacttggttccacttctgctcagcgacgagagacccttcgaggccctccctgaggctcttgatgactggggtgttgtccaagaaggctttcttcagtgccttcccttccttcgctcccttgccgatgatggagccgatctttccgtctcccgcaccgtataagaaggcgtagataaaggtcttcgcattcgctctccatgcctcgtggtcctcgttgtgtttgtcccgaatggtcccagcgggaaccagaccagcagccaacccgttcgcccagtgaacgtcaccctccagaacctcagaggcatacgcaccttcgtcgtaacgggccccgaagtgacccagacagcgcagctcaaggcctgacgcatcgacacccacttggcggaccttggcccacgcttcccagcccttgcgcttacgcacatggatggcaccgaagagagcgcggcaatgaggcccataaggggaactcgcggaagggacttggcccatgttcggatagctgtgagtcgcacgaccagtcaccgccccgttggggttgatgttgccgtggattgagccatcgtcgcggaccatcttgagccaagcgttatcaccttcggccaacatcccgaggcgcttctggatcatgaggtactcacggaccagctcgacgcaccgctgtttctctgggtcgtctacgcggacaccttcgagggtctcatcgtccaccactggggcaccgttgtcggtgaactcagtaggttcccagccagcatccttgaggaccttaatgaggtgcgctcggctgccggggttgaacgtgatctgctcgatgggcgtgtacggggcacctgtgacggtctcccgcttgtccagcttcccggccttcgtgaagatgtcaccgacctttgggtacttgacccgtgggtacttctccagaggctcaccagttcccggatggagaaactgagaggtgccccctttggctgcccaccatgacccgaaggtctggatcaactggaccaacatgtcctgtcggcgggccgctaactcaccatggagacgctcggcggcgtccaagtcgaacggaaacccgttgcgctccatttgggccagagtccatgcagcagcgtgctcaaggtgaaccgcttcgatgccctcgccattgttgaaatagtgagtgtcatccatgagcttgcggaacagcttcgaggtgacgcgaacgtcttgctcacagtaatcctccatcgcttggttacagacagcccactccatgccatccacatagggagtgccctcgtcttggagttggcgcatgaagtcggtcttgtactcgcccttcatctcgcccagtcgataaccccaagcttcgagagcgtgagaaccaaacatcttgccggggagaatcccagagcgaagaaggccagagtcacggtcacggatgttggagtggagcaggcggacgaggaccagagtgtccaacactttcttgcggggaatgttcaggcgcttcccgaagtacaggcgcttcagcttatcgagtacagggatgtcgtacttgatgaagttgtgcccgacaatgagaccgtcaggtttcgccgcttcttcttcgagggccttaatgtagtccgcaaagttggactcactgtaccgagtgtattgcccggtaaagtagtcctgaatggttgcgcaatggaacttcgtgacgttatcaagaagtccattcgtttcaatatctgagatgagcataggccctcctgtttaacggaaggcaacggcgctcagaggcaaccggattacctgaggtgtgtatggacgggtgttgaagttgaacgacaccgtgtagccgatgtaatgcgccgatttctcgtattgaatcgacagggccttgaagcggatgccacggaagtggttgccaccatagttggacagtgtgtgatctgccgggatgttctctgggcgaatcatgaagtccttgccaacgtaacccttaacgagatgccagttagggccagtctccatggcagacttcattaggccatgacgttcaccagcgagatacgccttggtctgttcgtccttgatgagcttcttgatggacgccgttagttcgtcctcaggctttggcgctggggcgtgccactcagggcgctcgcgttcaccatcagcccacgagtaacccatggattccaacagtttcacagcgagttcgcctttgcgcaggtgcgcgcgtacttcggaattagtcatttggtattccctcccttctacggtttggttggtttgtagaaactaaaaagccccctttcggaggctcttggatttcaacaatccgattacttttgagttggtagaaccttcgtgatccggcgatgtacgctggtgatatcgttcttgtcccagtcggcaactacgcgcttaccaacagttgcttgcagagcatcttgcgcggcagtaatggcagccttcagggaagcctcacgggccaccagcttttcatggcggcgagtttggatgcgaccagccagagccagcagtacggttacgatgtcgaagttgaaagttttcatgtggtagttctccttaatagtcggattcttgaccctgccagttggcttcggtcgtgtcggtttcgtcagcatcaggacgccagccatgaggcttagcgaccagtcggccagtacgcttgtcgtattccatgtaacccgctattccggtctccccggtgaagcggcacttcaggatgcggaacaggatcaggttcgggtttgccccttgctggttccgctccacggcgatgatcgtgtcactcagttggcgaagtccgcccgagcctcgcaggtcagtcgccgttaccggacgcccttcctcgtgtggcttgcccttgtcagggttcttcaagtgacagatcacgaacacagccacgcccttgctcttggcgaaggacttcagcttggtcatcagacggtcgatggtcttgcgctcatcgttatcaccgtccatggcagacaccacgattgagatgtggtcgaggacgatcaccttgcagccctcagcggccaccatgtagcccagcttggctaacaggcgatcctcagcggcctccgcaaaggcgtcatagaggaacagccggtcagacgcaaagatctcgtcaaaggctgcgtcaaacatctcctccgtggtctcatcggggttctgacggactcgtgagcccatgtgaagcccaacgatgtcctgtacggtttcctctacggcctcctccagcatcgcaacaccgcaggggatgccctcgttgtggaacaggttgtagacgttctgccgaacgaaggtggacttgccagagccggaaccagaggtgaccagaatgacctcaccttcccgcacatccttggtcatctcacggagttcatgaggtgcttccagaggcatcgaggggatgaccttcttttccttgatgcgggccttcagggacttcgcggataccacaccatccgggatgaatggtgaggcgttccagatctggtccgtgacggccttcgcattgcctttctggacgcattcgttagggtccttgaagggcaacacagcgattttcaccttgcccggagggagaacctcagcggcctcctgagaggcgaggcggcccggctcatccatgtcaaacatcaggatgatctcgtcgaactggtcgaagtattcgtagttcgccgcgcaggtcttcttggcagccttcgagccgtgcccgatggacaccactggatacttaccgccctgcaactgagccacggtcaggcagtcgatctcaccctcagtgacgatgatcttgcgaccaccattccagaggtgacggccaaacaatgcttccttcgagtggtcacccttggtgcagaactccttggacgcatcgcggaccttctgggattgaaggttgcccgcagagtcgtagtagttcgccacttggacaggcaccaccttaccagtgctcggtgtccatgccttgcctacccagtagccatagaggcgacagatggactcttgcaggaaccttgcaggcaggtcttggtagcgcccttggcactcgctcattagcagtgtgtcggcgtgccgggtgatctctcggttacctgtgcctcgctccttcccatcgggggccttgtaggcttcctctggagagcaggcgaaacagtattggtgaccatcggagaacagtgagttggcgtccgaggacccgcaggtctcgcaggggatgtgctgaatgaagacactttcttctctgtcttcactggacgacatcgcgtagctcccgctcgccatgcttcaggcccatctcgccattggcaggacggcccagcacgaggtcgagccacttctcttccatcttcgcctcacgggacccacgagcgtcctcacggagccttacaagcttgctccaatgctcagtgcccatgtaacgaatagttgccccgtcgatgccccgagggatgcccacgatggcgaactggttgaggttgtagtcgaacttgccgatggcctcgtagacacaatcggtctcgtaaaggatcacgtcgatgttcgagccttcgagcttccagacaccttgcaggcggtccgagtcggaacctgtgtggtacttcgggaacttctcgtagacgaaaccaccttcatcgagcgctctggaaacagtctccgggtcagtgcccgcgcagatgatgtcgatgtctttggggaccactccgaagaacaggtcacgggcacagccaccggcgatgatcgcgccaatgccatgttccatgagatgctcaacgaggtcgaacccaccttgcagtagggaacggttcatgatgacctccataagtcaaacgcaaaaaggccacaaagaaccgttaaggattctctgtagccacagtgagggtttttaaatcttcagccagcgcttgacgtcgaaggacgggcaggctttgccagagtcgaggtcgcggtgaccacaaatcttggcggcagggtagagcgcttggaccttctcaaggagggtcttcaggctcgcatactggacaggcgtgaagttgtcttcaggcttgcccttgtcgtcgataccaccagcaaggcagatacccagcgacacagcatttttgcccttgacgtgggacccaatgaccccatgagggcggccttcttctacggtcccgtcacggcggatgacgaagtgataaccaatgtcgagccagccttgctggacatgccattgacggatctcacggacaccaatgtccatggatgccttggttgcagcacagtgaacaacgatcaggtcagtgtgggtgcgctccttgaattggactttgggcattacttacctcctttcggaacgagaatcccctcagggatctccttgcgtacctccttgagccaagccaatgggatcagcttgtcagcgaattgaatcccgtgtttacggcagaagtctgcatagctcgttggggagcccttgtagatcttgctgttggaattcgagaagaccagacggatgtcgagggccgggtattgctcacgaatcagcaagtgtttcttgcggtcgtcaacctcccagatccctttagtctccacgatgattccgttgcgtagaacgaagtcgggggtgtatttggccttgcgggccggaacgatgtactcgatgtggaacagctcgaagtcgaaggcgaccccaagcttgtccatatgtttcgcgttgcggtcttcgaggccagaacggaaggcacctgtacgggcgcctttaggaccggcataacccatggttagaagtccacatcgtcgtagctggtgcgctcaggcggcgtgttgtcgctgtcctgttcaccctgccagccttgctcgcggtcatccggggcctcatagccttcctcggtttcttctgcccagtcatcaccaccagcgccgtattcgaccagcttgatgagcatgatggagtcgagttgcagcttgaccgatgcgcctgccacgttgctgaagctgtatgggaacagcgagaaacgggcttttagttcggagccaccagagatggccggaacggcttcgatgcgcttgcccttggcatccacgacacgcagaacgatgtccttggactccttggtcttgctgtcgatgtacgaggcgtaaccagccagcttgaaggtcacagtgccgtcatcgttctcgaagaacggaaggttgccctgatagggttccagcaggaccttgccgcgttgcagcttggcacgagcagcggcctcgccaccgttcttccattccttctggatttcacgccagttggcttcctgagcctttacgatctggtcgatcagtggttgcgcttcggcgcttggcacggtcaggttgaccttgtagacaccacgaggattgccgaagcccttctcggggttgccgtagtcaggcttttgcagcgagcagtagggctcagcgatgcccttaggggtgaagaagaattgtttcttgaagccagccatgggtatatctcctatacaagtgggaagtttgtgtgtagccacagtgagggtttttaaatcagtaggtcagcgactcgcgctctgcgatcagcttgtcagcaaagtcctgaatgaccggctgtttggtgatcttggtaaaggcgtggacgacctcacggaagttggccttcaggaagtccttgcggaacctcacagtgccatgcttcatgtggtagttggactcggtacggccctcatagatggccttgaggttcgcctcactggcgcgcagcaacaacaggcggtctacggtctcacgctgttcatcgtcaaggatgtgcgtatagaccacagcggcaacaccggacgccttagttaccgtgaagttctggatgtgcaggaagccgtctggcatcgagcgaggtttgccttgagcgtgtctcattgagccacctccgggatcacctctgggcgaatccggcgaacgttgtcctcaccgtactcaaggtcagccgcgtcgagggcctcctcgatagtacgggcgtacatcggaacttcttcggcgttcggacccaagttaacggtgaccagaaacttgcgcatcttttggttttcgaggttcattattcaattactccttgatctttaagttgcttgagcatgtcgctcgcaaagccccagcggttttccacatgggcgttcatgatgaagtcgcgcagctcggtatcggttgcatgcagtggcgcagagtccacctctgggatcacccagttgcgggtcaggcgaacgtgatgagccccgaggttctcaagggcgtcatactcgttggcttggcgcatgtcggtgacgaccactacggcaccctcaggggccttggcgatctctttgagaccctctcgcagccacacatcagggtccttcaggaagttgcggcggtagccggttccgtattgctgaaggtgccagcgaggcgagcggggccgtaccagttcctccgtggacaggaggtgtgggcctccttcatcgagccagcgcgcatagtcactgtctgggatgttgatagcggccaattcctcaaacggcgcgtccttgaggtcactatgcatgtgtgactccatgacaatccgggccttcccgttggaggtcaggacctcggcgcattggcgcttgagaacgtccccgaaggcgacccggtagacctcatagccatcctcgcggagcagctcaacgagggtgtctttgccgctacggccacgctcagaggtgagggcgatgatgacgttggtcatttggacagctccatgaagaagtagaaggcgttgacaaccagcacggcgaacgacaaggcgttgaaccatgggttatcgatgaggccccgcagggacgttcctacgcgctgccagaagtcggcctttggcgttggggcttgctcggtgaagcgaggaccacggctatggaacacagcgaggttccgttggcggtcgatgttgctctggtgcaggcgatgggcaaacgaacggtctttcatgttggttctcctgtgttgggttggtggatagccacagtgagggtttttaattccgcagctttctctcgatcagtagagcgaggtccgcagagatccctataaggagcacgaacaccgtgagggtcgcagcgatgcctattagaatgtcgagcatgatagatttctcctattgttacaggcacaaaaaagccccaccgggttagggtgaggctcgttgagttgcttgaggatcagccgcgaatcaggcagatcagcagggcgacttgggtgatgaggattgacaggacctgataccacgtcatggtcatgatgttactccttgatgtacgggtcagagatcccccggaactcgtcgaaacttgggtgccgcattgagccatcggggtagcgctccatgcactttacacgaaccgtgaagccttcgtaagggttaatgccagtggagtagccagcggcaaggaccgcatcgaggtacgcatcagtgaactcatccatcagcttgcggctgatcttgcaggcgttgaccacatggccggactcaaggagaacctcgaagccgatcaccttgccagcgttggcgagaccttcagtgccccagaccagacccacgaccttaccgtcttcgttgtcgctcgggaccatcttccaccaaccagaacacttggagcgtctgtagtagcccatagggtccttgcagaccagtccttcctcgccacgctcacgaaccgcagtgaacagctcagtgaggctcagtgggcgctcgcattcgatctcgttgccctcggcgtcaacctcgtggcgctctgggagggcctccatggaaaacacatcgtaggtctcagcaacccgccagtcgatctcgggaaagtattccttgagcttggcgacttggtactcaacgtggcccttacggacgca

SEQ ID NO: 10 - DNA, 39587 bp, unidentified
  misc_feature 1..11: note = bacteriophages nucleic acid sequence
  source 1..39587: mol_type = genomic DNA
cccttgatgaccgccagttcggggctgttgaagtacatgaatcgacaccggctgtgtgggtgcagcgccttgtgttggcgataaaggttgtcttggatggtctcggcggtctcgtagagatggcccagatcgtcaaccgggtgagaaatttgtgtgactttgaggaacctttcggaaacctcgtaggtcagactctgtacatgccgcccacatgggccgaacccggtagtaaactcgaccgctaccggatcgggaaaattagggaccttggagaggaacacgtaatattgccgacccttacttagcgagttacgtgcggatggtctgaaatgcatcgccgtggaccattcgtggagttcttcggcttggctcaccgacagtgagtgtgggtcttggccaaacttcataccgtccgcttccaacacatggattatgtggtaatgcaggcttaggcgtttgttaatcatcgcggatactccccggactccagcagttgccgtgcagcttccttgacgatgcaggtgttacagcttggcgaccagtagagagtccccttaggagcgtccgcatagaccgtctgagtctttgtccagcccacaaggtagcgaacgtcaatctggtcccactggctcaggatggtgcatgtgttcagatgctcgtcaccttcctcaagggctttcgccatcttggcccagtaggatttagtgaagctgcctcgaaccctgttgaggacttcagccgtgcagaactggccccagtagatacgatggcgttccatgccggtgagttcctttgcgcagtccatgtaccagtgacgggtcttgaacatctgacctttgatctctacttcttcgaccttgagttgtgtaagggccattgcgtgttgctccaattgattatcgagttgttcccctatgggacaccgttaagatgcccataagtggatgccctcaggtttaacgtacctcgtgcggctcgtggtgtgcagcggagcacaatttgatagcgtccttgatgtacccaaggccacctctgaagatcatccctgttgatccctcacggacccagtaagggccattccagccaccttggcgacccactgcgtactcaaggccacggtgttcaatgtcaaccgagaagtgcgccagagtgtgatggttctggatatcttcagcctcattacagacccacaggcattgcaggtcagctaccttcaattcattcagtttcattaccgcattccccgttgttgaagtgatgcccattggcgctcatggcgtgctttacgcaatattgaaactcggtgaccgcctgcacatactggtcgggaccgaatgacttctgcgagaacccgtaagtaaccagatagcgaccgctgggcttctttgataggtagaccgtgaactgcccaagctcgtcgtgtgatgcgatagtttgcatggtgttgctccttgagttgttcccctaagggacaccgttagatgcccttaagtggatgccctcagtagccagcccatgccctcagttcctgttcgttcaggaagggccatggatgaatcttgccgttctcaatggtccagatctcaaggtgaccctcgaagttcgtgccatggcagtagtaccaatcatgctgtttagcccaagtcacgacttccattgtcatgttgttgtagcgggacttcctgttgatgtcctgaataaagccagtggctcgcttgataagcttaaacatggtgttgctcccgtgttgagttgttcccaatgagccctcagagaaggcccatcagtgaatcactcgtggtctttcgtcttctgctctaacaggtcagccttagtgcggtgccagaccgccttgaggaccctgtagtgcgtcagcgtgttatccacttcgtcccgcagcttttcccacatgggatggctgtgagggccttcaaagcgcccaaaggttgacttagcggattggtgagcatcctttgcggccttgatgcgtactgccagatcgtcaagtgcgtcctgtagggctttggttcttgtactcatggtcagcttccttagctgttgtgttgcggtgtggatacggacatgaactctcctttggctcgtgctcaatgcttgggttacacgagagttcattaccctattcactactgccttgcatcctctcccgaccagccgcatccaatgcgttcggagtgcttgaggctaccaagcaaggcaggtgttacattccaagttgttaaagagcggttgtttcagtgcgtacctctcccgtgcttcgtcctgaggacagcctgaagggtagcgcttagcgtctggaagaccgctattgttctgcgctttcgtagaccaacctactcgtgacatccgttcggttaatcgttgttgatgttgcgtattctacagcgtttgtacatcgtgtcaagcgtttgtttctcagcagtctttagggtaactcgaagtattgcccgacccagactgtgccctgtaggtcctcggtgtcagtccctttggtcatctcaatgagacctcagaggccaaggccgaagaccgtggcgatcaactcagtgtttgccgttgatgggagccattagacaccatgaattgaggcatgtctacctgtttattcatccagtgtcctatggattctcaatggtccctcaatggttaacgaaacgggcgcacacgcggataacctatagaccctcagtggtcaatactggatagaacaacagcattgtagccaagaacctgaccaatcgatcaaagagcacctctgaaagccttatagatcaagggcttgaggctattagcaacgatagactactaccctatgccatggcctacctttggccctaacgtgtccctgagagcctctgaggagcttgtagagggtcttaccgttcgtctggttgggttcattaggagcatggcccagtggtgagcattaggagccctcagtggttacccaaggagcccattagggacacaacagatagagacagacggagacatagagattccctatgaaccctctaagaacccatagcgaatactcattgtacacctcatgcctatcggcccataatgatccccatgagatgcccttgagggatcaggcaggtatctcaacgagcccatgtggggatgaggtggcttagagtagactgagagggcccctacgggggtaatctcggtgtctgtccatgagaggtgctctctcagatttttctctcagattctcaaagagtcccattaggataccctaacgatccccagagtcaataccttctatcggttatcctaacgaataccctgaggaccagtaagaccagtcattagggtgttcattaagggttgctctcacagctcaatgaggtagtgtgctaacactgccgaaattgagcctcgcgtctgtcaatcagcgcacccaccagatgcaacgcagatcagggttgaggcccatgacatgacttcggacccttgagcgaagccagaggcaacgaggataaggccgagcagcttgtaggtggaacgagagagagccagccgcttcagtacgagcagcacagtggccttctctacgttcatggttactggtctcctttgatgggtgatggctattgccattaacacctgacctaagagagcgagggtcgatgccttcggaggtcatgatgctcatgaggcccgaaggagatctctaagctttaatcacttaggaccccctacggtagccatagtgagggtttttaaattcgtgctgataatgaccagatatccctatccggtcacactttaccagcccatgaagttgctcatgctgccgtcatcctcgaactgaatcgtgagggaatcagccatggacatctgccgggtttcctcccagccgctcatagcgttctcaaggtggctctcaaggaactcctgaagcatctcctgctcgccggtcacgctgttgcgctccatggcctctacgaagaactgcacgccgattgcaagggcatccagacggtcatcgtgagcaaggctgcctctctcccgagtgatgcgtgtaagctggtagaggaggctgtaggaggtgtcagtggttccgtcgttgttcagagcggtccggtagtccttgtcgatgagggcctcactgagtaccagcttgtgagagcccaatacaggctccagaacgtcgcagatgcgtagttccttctgacccttggacttgacctcagtgacagcgcacgggtaggtggcggcgatcacagggctaatcagcttgacgtacataccatcaccgaagttgccttcaatgaccacctcgttgaccttgtagatcttggcgatgttcgcaagggcttgcagggtcgtgtcctcatagccaccacggaagcccccagcgtccatcacgaagatgtagccgttgagctggtacaggactgcgtagccggtctcatccttaccacggcccgaggggtcgatgacgaggatcttctgggcgtactcagccatggcctgaccgacagactcatagcgatggaagcggtcacccttgaggcccaccagaggaacccctttgacctcgttagcggcgtttggaagccatgtgagtagggttggacccttcgagagatcaaacgaccccacgatgaagtcacgcagcttgagagggtacttctccatgtcggagaggttcgggttgagcatgaactggagagcgaagccgcccttgccatacgacagttcccgttcattcaggtcagcgttgtcgaatcgcacagggtctgtaggagcccagtaaagccttgggtcatcttcgagttccttggcgagcataggagccagccttgggccgtacgagtcgagatctgtttggtccttagggtatctcgcaggccagatcgtagtgacgtagccacggccttccagctcgcggtagagggtcatctcggtctgaggggtgcccagatagatgatcgttccgcccggcttcaggatcgcgtcgaattccttaacgagttcgccaaggtgatcgcgagcggcctgagttccagagttgttcgggacctccacgtcatccgcaatgaggatgtcagcacgggaacccgtaagctgcccggtgatacctacagatttcactgagggtgagtggtcgggttttgctggtcccacgtcgaacgccagagcggagtcacgttgtccgacccgaggtttcagctcgtgcaggaacaggagcaggtcgatgatgcgcttgatgaagatactgttggcgtctgcccgctctttggaagcggacacgatcatgaacttgaggtcgggattgttccacaacttccacacgacgaaggcgcatgtgatgaaggacttaccgatacctcgaaatgcttgaaggataaagcggcgttggtcgccactggaaagttttgcagccatgtcgatctgacacttggtcggtttgggtagattgagtgctctccacagtacgaacaggaatagaacgaatgactgtttgatccttttgagatcatcagtcggtttagtcacttgtgcctccagatgtcataagccagacacagtagaaggcccagtgtgcaagccattacgaagaaacaaaggaacatcagagccaagttttcctcgtcgcttattgggccggttggggtacttgccagaatcaacatactcgtgacaatcattgcgttcattgcttacctccttgaagtgctcttacagttccttgcagtgcctttacttgggcgtctgctcgctgggcttgctcgataaggaatccagcagtgtctgggtgtagttcggctcgaccatcagtgattgatcgaccgtcacttgtgatgcaggacacgatggaatcgttgagcttgacttgcagccggataccacggctacgcagatcagcaatagtccgatcagcaagttccttacttttcgcaacatgcgtttgccaagcggcactttgggcgttgagggcgatttgggttgtttcacgttgtacctccagttgtcgagtcgcggcgagcatctccgcttggtgggtaatggtcagttcattcgttgcatctttgtgacccttggcgtacgtcaggccgagacctgccgaaaccaaaaggccccagatgacgaactcttttaggttcaacataaggggcctcctttagtggcgagcagcggaaccgtaaagttcctcgtcggttaactcggggacttcatcgagagccaatgcgagatctcccagaagggactcgtcaggcttcaacttagcgatggtgaacttgtggcgctcaaggtacttaccgatggcgttgtacagttgaggaccacgccgagcatcgtcacgcaggtcagccagaagttgacgacccaagtcggtgtcgattgcctccagcaacttttccagcacgttatcactcatggtgggtctcctttgttcttgcgcttctcatccatgactgtcttgaagaccagcacgatggtttgcactactgtgtagataatgacggttgcgtagaaccagtcactgagggtcatgcctgctacttggcttgccacttcggcaccagccccagcagcgataggagcggcgcgaaccactccattcgtgaagtcgatctcaagggaagttgccattacgacatcgccttgatctgcacacgcagactcttagccagagagatctcttcgggtgtcgccaagcccaacatgatgtccggcatcagcttgtccaattcggactgtaggtcgtagatggtcacatcaggacggacgaattcggcaacttcaccatactcaccagcctcagcggcctcgaaaagaacccgaccgtgctcctctacgtcatctggacgagcagagaacgggacatatcccagatccttgaggtgctcgaaaagaacttgcagggtaatgaagccctctgcgtctcgcacaggctcctttgcgtctaatacattgatgttcattgtgtcctccataaagaggccccgaagggcctttaagcaactcgcaggtacagactgacgcccgtactggttccgtatcccatggatctccaagtaccaccaccaaccgccccgccgttgttcttgtcaacgtctgagtaataaaggctggcaccagacatagagttaccgggtgcgttatgtgaaccagcagtgctacggcagaatgcataagttccgatggcaccagcggacccgtttgatgcgagccagctattgaagttagcgttggtgacaagcgcccggttattaccgtcactggccatgatgtttaggtcagtaccattcaaccaaagggcaagcgcataatacccatcccgcaggaaggtataagcaggcggggagttgtctgtagtacgagcaacaaagtgggaattgtcgtacatggcagagctaataggtacgccattgcgcgtagtaacgcaccggccagagttgtaaataccaccttgagtttgaatctcgcgcccattagggaactcaacggcaccattcgagcctctaatgatgatcgactcggttttaccggccacacggatgttgaggttgttgttgtagtcgccgtagagcaatgcccgctcgcttccgtcgaagttacgcatccagaagtgggtgttggttgcattgctccctgatggggagacactgaagacatcgatggccttggcctgcccggtggcgttgagtgcccctgtgacatccaaaccgcccttagcggaaaccttaccgagaacttcaagggtctggcccagcgacacagtaccccagacggacatagcgcctcggacgttgaaggttgcagcccggatgttcacaacgtcagcggaacgaccgtagaggtcatcagcgagcatggtgttgaacgagagttgataaccgtcattccagatgattcgctttgggtcgccctcaacggatctcagggtccccatgaattggttggcgttacccagcttattcgcctcggtagttgcccggtcggcctcagtcttagcggtcgtcgcagaaccagcagcagcgctcgcagaaccagacgccgcagtagcagaaccagcagcagccccagcactcgcagcagccttccggctgtagtgataggacgaatagaggccgttgtagaccactgtgtcctcaacctgagaggcccagattctggagttattctcggacgtggacgcggcctgttgggattggcctgcctgattcttaaaggtctctgcctgattccggtattgcagtgagaggtcccgagcgtcctgagaggccccagcagcggtcacagaggccgaacggtactggtccgcctgattggcagactgggcggctgcctgtgcctgattgagcgcagagcctgcccattgcttctgttggcgcaggttgacagcatcaccatcttcgatggcatctgcgaggttcacaatgcggcgcgcacgggcgtcgaggttgccatcgttgttcacgccgattgtgtcagcggtcaggtcacgggcttcctcagcgatgtgcagggattgcacgctggagatgttgagatcgtaggcccgcaaaatggaaccgtcagcgaagtccacgaggcgctccgaagcggaggtaacccggcgaatctcgatgagatcaaagccatcagcagtgccccaagcgcgggtcgtagttatctgcgttgcggtgacgaaacgataatcggtgttcaggacaagttctctccgagttgccccgatgagagtcacaacgatgaacttacgagcgagatactcgaaggggatcgtaaagtctctgagggaactattcagagtccacgtccgcaccgttttgggtgtggtagccatagagtctccttaataaaaaagggccctcgaagtgagagcccagtagccatagtgaggggttttagcgagtgcggtattccatgccttgcgactgcatgattgccgacattgctttctgcgagatcgggtcgttagggaccaaaccacgcagcccgttatacaaaccagtcatgtaaccaagttcctgagagttccttggagaactcccccagataccatcagcgttcgcgccgacctgatagaacgacccaaggacgcccattgagggcacctgctcaaggactcggctcaagggagcctgaatgccgtcagagcgaagtgggttgtaccgggttgggtgctcacgcttggtgaactctgggccacgcgggagaatcgaggtacgcacagcagcagccgggtcgtaacccagaggagccgcgaagaagttcgccacgccgataggtgccccgatgatgttccctctggacagagcggcccagccaatcatctccttggtcattgcctgcttcaggaactccttgcggcgttcttgagcgagaccctgagcctgcacgtagcgttgagccacatagaaccccgttgcgaggcccgtggagatgacagcctgtagggccacatcgagtgcctgaccgttcttcgtggcgttgtagtagctgcgcacgagacgggcattgagggtcctcaggacgaacttcttgaactggagcgccatatgccagccagcgcccagcgccttggtgtcctgagaggacagcttgtgaggacgcaggatggtctcatcggccaccttatcgcccagtctccagaggtccatggtgcgtgggtcagcccggaaggcgttcgcatccttgatcttatagctgtcgccatccttgacgaggtgttgacggatgaggttcttgatgtctccaaactgggcctcggtgatcgacagttggttgaggcgttccttggtcatgaccttggcgggcatcccgtgggcagcgttcaccatgtccatgagggccccttgacggccagcctcgatgatgtagttggacgtctcggtgagcatccgggtgaatgggctccgagcggcaagttcctgtgtggcgaacttcagggtccctacagtctgagctacaggcccactcgaaacctgacgcaggcgatcaacgatgtcctgacggcgagggcggataacatcatccagctcccggccaaagacgatcccatgcatctccttgaggttctcaggggtgatcttcgagccccatgtggtcatctcccgcaggaatggtacgccatgcatcagcatacggacgtgcccattggtgaccatcccggcgatctcagtgaagttctgagcggccatgtaggcgttcttcgagaagaaagcgagatcgttgagggaccttgcgattgtcccaaagacaccatcaggatctctacgggctctcccggtgagcagctttacggcgctctccagtgctgtagcgtccttgtggttgcccatacgggtctggatggcgaggacctcctgtttcagcgcatcggtgttcttgccagttgcacccatgatgcccacgtcgccgttgatacgacggtcgtaagaagacatgacccgaggcacatcgaagacacggagatcgttcaccgcgaagctggaaccgtctgacagtgggacagtaacgtccgagtcgaacaggttacgggcttcaaggaaattgttgttctccgcacccacgaggttgttcagaccatcgtctatcagggagctacggttaaacttggattcgtggctgataccaaaagccttgtcgttggcgtaccgcgttacggctgccttgatggcctcgggtgtcgctaccttgccctccttctcaatggctgccttcatggctttatcaacccgagccttgacgactgggcgagcggcataggaggccaaccatgattcctgaatggcgcgctgcaaaccatcctcaccgccgaagcgacggatgtgcatagccttggctgcgtcatcatagatgtgagggacgtaggacccagcgtggcgcgtggtgtccaacaggctcaccgcttccgagttaccgaactgggcagggttctccagcatgtcctgcttgcgggtgaagtgaccattaatcacatccatcagctcacgttcttgcggggacaacttggcctgctttgccttcgtctggtcctcaatggcttcgacgacccggcgataagccaactcacgcttggacaagatgcccggctgcgtggcgtaccgagggtcctccttgagggtcttttcggtcagctcgttcagcttcccgtaggtcacatggtcctcccctcggatgcgctcaatgatgtccgaagcggttgccccaaacttgccattggtgcccgactcggtttgcaccgtggagcggaacagttgaccacctatcttgcggatggcttcgtcttctgtacggttgagcgtgtagccgatctcagcgatggccccgaggttgaacccagcagccgaacgctcaggctccagttgagccactgcgcgcagggtcttcgggttgatcgggttggacgcagagatgattgagccgtcacgcagacgcacagcgcccggttcgcccggaacgtccacaaagtcgattccatcgtgactgtcgggaacgtcatcggagttccatggcatcttggttgggtcctctccaccagcgaggcgcgcatcttcacgtgcctgtaggcgcgctgtgacgctgtagaactcgttgggttctgaagactctgcatgacgcgcaaggatgccctcaatggtgtcatcagggagatccttgagtccttcttggcgggtgtggcgttcaccgtggagacccaggatcttctcaaggtagtcatcgtcctgcacgtcatcacgcacagtcggtgtggttggctccatgccgtccaccagatctaccgaagcgttgggctcagaggactcaccgtgacgcgcaaggatcgcctcaagggcctcatcgtccatgtctgggcgagcccttacgttgctcacgccacgggcgatgtgcttgtcgaggacagcggcaaagccactccccaacacggcaccaccaacagcagcggccaagtagtgaccctcgatcccagtggtctgctcacgcagagcctcagagcccacagcgagcgccgaagtgaacgcaccctgacgcaggacacggccaccaaacgtggcagcctgagcgcccggtactgggatgtacgaggttggatcaagcggagcctgagcgacaccgcccagcaactgcgagccgataccggaatcccggatgatggcttcgttcgccatgttctccttggctaccgcaatggcgttggggagttccgctttgaccccgtgagtcctctccacaaggaactgaaacatcttcggagggatgcccgcttggcggatctgctcgtagtcgtcatcgtcccattgggcttggattggactgtagtcagccagtgggtcgtgttcctcctcacggaagaggtcgcgcagcttggcgcctccccatgagttatcaatggatgccacaacggctgggaaggtgttgcggaaccatgagtcgtcctgaggcccgttctgggcgtagtccatctcgtgaaaggtcttctgggtctggggcaatgcaccctcgctcagattgaacccttcaggtcccttggagttgccacgctcaacctgaggttgcttggtgagtccttgcgtgtatttctcgaactcaccattttgctttggggcggaaggctggtcgaaccacttcttgctcggggaatccccagcgacatccagaaggttcgccatgtagttcttgccttcctcggagatcttcgagaagtccccacgatccagagcggccaactggggagaccccaaccgaccattgccttggttgtacgccagagcggctttcaggtagtcgcccttgtaggtccccagaaggtccttggtgaggcgcgcagatgcgtcgatggacttggcagggtcgaagaagtcttcgtctgtaacgagcccgtaggcccgtccagttgccttggtgaactgacccagaccacgtggccccgtagggctcttggcgttggggttgaagctggactcgttgaagatcttcttatgcaggtagttgtagtcaacaccgtgcgcatcagcagcttcccgaatcatctggtcgtatggcgtgccacttgccagaagttttgcgtattcgtctttacggctcattggagttctccttacatgatgccaccaaaagtctgacccgctgcctgtgtagccttggcacggtcaaccccttcgcggaattcttggtttctgagtgcttcctgttgggccttgtggatcaactggagcgattgctttgtgaggacgatgcgccgcccggtcggggacgctatgttgatgtcgccggtgttctcgttgacgcttacggttgccccagcgcctgcccaagcgggagtctcaaggaggccctgaatggtgcgatcaacaatttccttaccggcctgccacgagttcacgtcctctggggaggccatgaggctgcgcttgtcgagtctcccgatgtagccggaatcttcgtcaccctcggtgaacgctaccgtgttctggttgagccactcggtgagcttttccttggcgagggtcgggttacctgtgcgctcgttgtagccgtcatagatgttccgagccatgcgctgaaggggtccggggatggacgacaggtccttgttggccgagtcattcatcaggttcatccattcctcattgcgaaacttctgttcctcggttgacagacccttcttggacttctgggcatccacgagaacctgaggctcgatgccgctctcggccatgtccttcagttgctcaaggaagtctgcttgttccccgaagacgttcccgattacagcggagttcgtcacataggccctctggagttcctgtaggcgtggcatgtcaccaacctgacctgacctcaaggcacctgcccactcgcgctgtgcgtccgtaatgagggtcttgtagtaggtctggaacggcccaccgtcatagtcagcgttgaggtactgggcgcgcatagcgtcctgcttctcctcggacaggccagagttcttgatacggtccatggtgcgggccgcgaacgttggtccatcggactccttgaattccccagtgtcaggcgttacggcttgatccttggggttcactgggacgttctcaccggcgattcgcttggcatacgcctgctccatgacatccatccggttgtccgactgggcagcctgcttgaggcccgcagcgcgtctctcggagtcctcacggacacgagtcagcaacgtctgttcggcgttaatgagcatctgcttttgaggcgtcatctcatcaccgacctgcacccatgcgttctccgtgcggaacttctggatcatcgtcatcccgatagccgggtcgtcttggttgatcgcctgagtgatccccagagagaacgtcctgaagcggtctgagtccttcttgtaggagttctcattggccttgacgatggcgttgtccaagacatccgcaccgaagaggtcctcgaccttgcgggcacctccaaggacattaatggactggccgcgcaggttctggatcagattggcaccaccgggcttggactgagcgtccgtcaccagttgggtaagcgcggtcatcacggactggtcagtagggaactgtcgggtctcgatgccatggttgaagtaggctgcgatctgaccgccaccagtgggcgtcatcatcacctcagggtcatccagaagaggccccaagtcgccccgagcgttgaccgctgtttgggactgataccacttcgaccgacgtgtatcgtgggcatcgaagagagcggcattccgctgcacgatgtcaccgttgaaaccacgctgatactcagggtcgttctccacgaaacccgaggattccgcataggacttcgctgcgtccgttaggcgctgttgccggtattcagccagccacgcgcggtccttgttgtcgaactcacccgagttgatcttggtctggatctcactgtccacgtcataggcagcagagcgccccgacttgtagcgcagcatgttcattgcatcagggtcgtcctgatactgaagggtgcccgcagagatggcctcacggatctggtcgggcttcagcttgcggatgatctcgtcagagcgagcctcagcggatttctggctggcttcctgataggccccataggcattggtgccagcctttacgaagtcgttcatggccgcagcgaatccgttagaacccacaggggcccgttgagcggacgcttggaaccctacggtccccactgaggaattgagccgaccgctcttttgcatctgagcgccgtctactgcacgctcgattgagttagccattacttagtacctcctgccgctgtaccgttggattgagacccaccacctccagacttcgccatcgagctacccattgcgtacccattggcacccgcagagatgatccccaaggcgttcgataggccgctggtcttgatgacctgagcctgacccttgagggccgacttggtgttctcgacgttggcgatctggttcgcaaagatggattggtagtcgcggtgatagttatccaccacgtccatgcgcgcagccgacgattcgttctcgacgctgttctgtatgcgtgccatggagttccctgagagacctgattcaccgatggcggtgcggatggtcccccggttacgggtcgcctgtaggttgatctcggtgagttgcttacgggcttcctcttgcttgtcctgagcggacaggttgaggttggcgttagccatgttggtttgcttgacctgctcgcgggccgttcggcgctgggcgtcttcagcggcaccttcagcctttgccttctcagaggcacccatagcggcaccggctacagccacaacggccataccgatacttactggttcgcacatagcgattctcctatagccagaattgacggaatgcaaatccagcctgggacatggtgatgccctcagagaaggtggcaccgagagactccagcagacggatatgcggtttgttgttgacagagacgaagttagttagggccttgttattcggcacatgatccttgatgtcctccaagtgccctttgagcagcctgtagaacctcatgcgttgcgccttggtcagtcgatccacaacagtggtcgtcacgaaccagaggcagtccttggacccacctacagccaaaaccaaagagcccaccttgatcgcacgagtggtctcgtcgaggcaggcgggcagggtatcgcgtgggtcacgcccagccgtgtgggaatggaactcgtcaaggtcgttcttcgagaggttccctgaggcttcctcaaggtctcgtttagttgcttgtgtgataatcatgaaaacccccatagggtgccatagtgagggtttttgaggcccccacttgacaactgttagataccggaagatcggcggatgtagttaccctcccagccgcacccgatcacgttgaggggattcggtgtatcgctggtgatggtcactcgttgattgagcgcgttacctgttaccgggaacttgtattgacctgtgcccagcgacagctcgcccagagtaataccctgaccaaggcgaccacctgacataacgtaaacgtactcagttgagccgttgctcacgttgatctcaaaggaacccgattgctcatagttgagccatgcgcggcgaagttgcagccgaccaatgtcctcagtggaagtcgagccatcatccgcagtctgcttgatgaggaacttcgagaactcatattggaaggtgtattgcttaccgataaccagacgctcgcctgcacggttgcccgtgaagtacaacttagatgaactggtccatggtccttggaactctgtgacgacacctttctggtccagagcgtagaacaccgcgtctgctcccggtactccgccatacacactggtgagatccaactcggttaagttggtgtcgatgttgtacgcgccgagtatcacttcccgcttcatgtccatataggcccggtaaggctcaatggcgaagtcgatagtgtgctgggtgaactccatccgttccaacatgatcccctcaggtcgttcgatcagcaggaacatataggacccgatggcagccgctgcgaggatcttggtgttttccccaaagttccaatgtgagaacgactgttgctgtaggacctcatcgagatacaggaacttatagatgtacacattgcccggctcaccgtccgagaggatcgacacgaagttctcagtgcctgacccatggatagcgtggatggtgttcggcaagtagctcggaacgtgcgcagagacatcctcagcggacttcacgtcagagacatcctgaatcgcgtagtaccgcttgagggacgtaaaggatgcccgtggagcactgaagtaaacacctcggccaatgccgtagggtcttgctccatcgctcacgtcaaactctgttgtcaggtccagctcaatcgtcttggacgacaggatgccgttggacgacagaacgaactgggcttgatcggaccatagcaaaagctgttccgagaacgggaccgcgtacttcagaatcgagatgcggttatggctgatagctacgtcaatcgggtcgtcatcactcagggtcgctacggacgctgggaagaagttgaagtaacgtgaagtcctcgacatgatgacgttctcgcccgagaggaaacccaagcggttcctgaagaagaacacgtcattgatcgttgagtccacgaaggacggcatagggttcgtatcgtcgtcaccacaggcccgaccgtcccaacttaggacagtccacgagaaggaaccatcagcctgacgcacgagggcatgcggcatggttgccccgttgaaccctgagatcatcttgggcttggcggtttccttccagaccttgcccactgcgtcatagacgacccagtagttgtcccctgagcgggcgctctccccggtgatctcaacgatgtacccagagggtgcgttagctggcagcttgttaaacgactgcacctgatagatgaaggcattcagcagcgtgtcagcgtaaccatcgcgggtcccgatagagcttatgttggtcccgttcggggcggtgatgaggatgtagccagtgcctgccgtgaagttccaaccagagggcccgagcgccgctgtgagttgtgctgtgagttgctcagcgatccatgtggcgtctgtcatgtccacttggttcatgcccgcatagggctcacccgaagggaccttctcggcggaaccgttgggcatcttcacggatgcgaaggtgttcccgttgatgaggaccgaaagggtccgaccgtactgaccaccccgtacgttcacgagggccctctggagcagcgcagggtaacccgaagccgtcagtgtcgagttcatctggacggtcttggagcggttcacaacgaacgtgtagtcagccactgtgatgacccgaaggtccgtccgtgggttcgcacagttcgcgtagccgttgtatccgttgaccgcgtagttgttacctttgaggtcccaaacgtagacacctgagccactgaaggccagatagtattgctccttggcgtcccggttgacgaggtggaccagaggcttggccccgagatacccaacgttctggagacgcttgaggaacgtgctcggcggtcgcttctgtagaccctgggtctccgacgaccagccattgatttgaacctcgccttggttggagaaccgcaggatgttcggttgctgcgagatacctcccttgaggttcttggtggattgcgaaacgagtcccataggccctccttatcgtgagatgagcccgccaacgaacgagtcgccgtcaagcatgttgaaaccgccgtagtccagctcgtattcctgaatggcctgccacgcttctttctcctgctcctgtagggcaccctcaagttccccggctccgaagaacctgatctgaaacctgcgagacgccttagcgacgatgtaagagcggaagcactcaggcatctcgccgtaggtcttcaggcggatgagatcgactgtgatatccccggcgaagatgtcggtcttggtcgtccggtcgtagacgtaaccgccccggttgatgaacgctgtaccgcccgatgtggtgatgcgcaggtagtcgctcatgtattcgatgaggccactaaaggtgtccggggagagcgttgcgccttcctcaatgttgaacgtccagcccttcgactggatctcacggttgacctgattgaggatgcggcgacagttcgctacgtctgcgttggcgtcaccctcaagggaactcacaggggactcaccgatggccgcgagcatgtcgttaatggccgcaagttcgtcatctgtttctaatgttgcttcgtatgaacgcatggggttctcctaaacgaaaaacccctcaaagccctgtgagaggccctaaggggtttgtggtgttacttagacggctggagtgaagaccagcgcaccagcggcttcaggacgcaggccaccgtgacccatggcgtacttgccaatgatctggtcggcttggaactcagcacgacgagcgcgctccagtgccatgtccttcagcttcacagtgcccacagcggagcggtgattgaacaggccaacaacgttgttctgagcaaccttgtcatcgccggtcgcggtcagtgggaagatgtgcttctggtttgcaccgtcagcatcagtacctgcaccaccaacgaccaagtgaggaacttcgatgacttcgaagcccatgacgttgcggatgttgccggtctctgggtcgatcagtgccgagtagttggcagcgttcggcatcagagcggacaggatcgcgctgtagtcgtccggcgaggtgtagaaacgacgatcaccagcagggacgtagttcttggtcatcttgccgcgagcgagggtcaggcccttcaggatcgcacggccacgggcttcaacgtcgatcaggtcagcagcagcgccgatgttcagaacgacagcagtacccagaccagcgatgttctcgttggaagcggctggcaggttgcacagcttcgccatctcagccagaacggcaccgtcagcagcgatagccagagcctcacccagttgagccgagtattcagcgcgaacgtcgtagtgggtcatggcgtcttcgatgtcgtagatcagcacgtcagaagtcagcagaccgtcgatggtgatgaccttctcggaatgcttgatgtccttgcgcttgtcatcgaggttctcgccgggtgccaagtagtaacccttggtgcggcccatgaccgggaagcttgcagacttgccgttctggatggtgcggaccatgtgtttgtccatggtgaccgaacggcgagcgaacgcagtcaggacttcaccaccgaacaccttaaggaacattgccagcttgtcggctgcgctttgacctttgccttggttggcaccaatttgttgaccgccagttgcatttgccatatatgagactccttctattagattcattgggacacacgaagtcctccaaactgaattggtggaacttcatgtagccatagtgagggtttttaaatctggtggattaccagttggacttgtaaacgcgggcctcaacggctttgcgataacttgggtcgttctgataacgcgggtcggacattgcagcgaccatctcgcgctgggaggcataaccctcaggacccttagaggtcgccttgggagccgaagcgcgcttgttgacggtacgctctggggccttgccgaacttcttcgagcgcgactgcatacccagattgatgatggtcttaacggctgccagatcctgacggctgatagcttcttcgagagcaactacagcgtctggggagttcgcagtgaggtgagcaagaacctgttggaacttctcaggaccaccggcgtattgttggatcttcgcaacgtacttctcagagacggcctcttggcctgcaatgaaagaacgcacgaaaccacggctgtagccaaccgcttcgagagccttcagggaagcctcagagagggccccatcgttggtctcgtagtcggcctcaatggcgtctgcctgttcaggcgtcagacctgccttaatggcttgggcgcgcagttgctggaaaccttctgcgtactcatcgatctccttagaggcgttgaccagttcagcgtcaggctcgccaagtggggcgaagtcatcggattcagcgtcatcgttgacaccatcctgttcgccttcttcggagccttcttcttgttcttctgcgccttcttccagattggactcttcgccctcttctgggacctcggagaactcgatggaatcatcaccatcacggacggaagttgggagggccaacatattctgctcgtgttcggtaatgttgttcgaggacattactgcaccattgacaccgaactcggcgtatacatcagtcattgaaagtctcctgtataaaatgagggccacacactcaaagtccgcccgtaggtttccttaatcttgtgtgtagccatagtgagggttttaaacttgagcgccgattgcacccggctcaacaccaacagtgtccattgcggcactcatggcttcgggacttgcggtcgcctgagcggccatcccttgacccagaccagcagcagcattgagaccgccctgttggagcatctcacgggactgcgcttgggccttctcggactcggtgagcaacagcccacttgtatccagaccaatcgcattggcgagcctgagcttgatgttgctcatgttgaggtctgcatcaccttgtagctgcgccacgttcgccatagaggacaggaactggttcagcttgtcgaggtcctgaccacggcccagcgcttccacgccagtgctcacggtcggctcaacggcttccttgggcatgtcagggatctgcgaggtcgcctgaagctggttcaacaggatgcggacgataggcaactggagttcctgcgagaggatcgaatagacgcccccaagggtgtcctccagttcagacgccacataccgaatctcttcggctgtaacgcgttcaccttgtcgctgcactgcactgttcagcataaagacgtaactcagacgcccctcaatggcatcagccacggacttagccactgtgaagtcagcggtcttttccagttgcaggaactcaatgtcgtccttgcggcctgccacgaagtcacccgtctgggccttgaccaagcggcgaacctgagtgaccccgttagggttcaccagaccgatcaccttcgaggcgatcatcgagaacttaatcatggcctcgtagaggttctcaagggacgtgaggtcacccagatactcctcaacgtggctccgaccatagtgctcgccgtcccgcttggtccaccttacggcgatccatgggcaggcatccacagggtactgaccgtcagtgccatccacttctgcgccattgacttcctgatagctcaggtactcaccggactcatcgtcgagatagacgtgggtgtacacttcgatttcctgctcgggcttggcctcttggccttgcgtgtcaatgctgttacggacatcctctgggagagccgcataggccaccttgtcgagggtcacgatttgcaggacattcccgaaggcgtctcgctggacaacgtggttgtgcaacgtgtagagcttcatcgggttgtagcttgaggaacttgcgtcaggcggcgggaggtaaagcaaccccgagcccgatagagccaactgccggatcaactcaaagagcgtcacgcggtagctgttggcttccatgtaggacatcaggattcgctcaaccatacccagaccctgctcaacaacagccagttgcgacgggtcagcgaccagttgctttgcctgccattcggacaccttcagcttcatccacgtttgcaacgggaacagagcgagcatcaccttggcggacaggttgttgagaccacgggccccgataccctgccacggagttgtatagtccgtagaggcgttgtcggagtctttggggaacagggaggggatagtgaccttggcgcagttctccgctcgggtctcgtagggaacgcggtcgttcttcagccgttcatagacggcctttgcgccttcctcagcgaggccctctcgggcggtagttgccatgggtcacctccttaaatgttgatgccagtaccagcggagcgggcaacttgcagaccgcgtttacctttcgcacgggcggccttcttggcagcctcggtgtcgccatcgtcttcaccactggtgtcctcagtgggggcctcaacggttgcagcagcgacaggcgtaggagcagcggcttggactggagcagcagcttgttcgactacctttggcttgtcgtcatcaccacccaacaggccgccaccgatggttgactttgagacgaccttcgtgaccttcttgacgaccttcttaattttcttccccatggggttcctccttcagtttcagatagttgatctcatagcggcctacgcctaagcgcttggtatacgccatgaccttgtacagactcgcccgagcgattccggcgagttctctttggagccgcaatgcggtccccgttggggcctcagggaagaccatccgccactggacacctaagaggggccctacatggctgtcgtcgtcatcagtggctacagcgaacgctacaagcttcccagaggcgtccctaacgaccagctcgacccacgcctcaagatcctcagtggcctcgcagatggcctcgtaggcttcctcgtgggagcgctgcatggtcatctcggggaacatctgaatgatctctgtgaggcgctcacggaatacggcttggtcgccttgggtacgccactgcgttatcacttggtgaccttcttcacggcccgcttaacggaactggtagaggtctttttggtggatgtgaagccggtatctttggcgactgccgaaccgctcccatcacccttgtcgctggccgaagaatccttctcgactgtcagaccatccacgccagattcagtggattgatcgtcctcggatgcgccgaagtccacgcctttaggttcctcgatgagaaccggctcgggtgccttcagtgcatcagggttggtcttcggagtcttgactttggatttgaaacacatggccttagtcctcctgtctttgacggtcctgcatcagctcaacgatctcagtggcagcattacagccgtcaaggaaaccgaggatgtagccttccgaatacccagccttccgcaggtcatccagcacgccagtggcgagcagataggattgactgagacggactgagaggtactcggcagaggccaacgggatgtcagggatatcgtcggggttttgaatgtggtgtttaacgatctggagcatgagccctccttaaataacgaagggtcccaactgagagaaaatcagttagaacccctataggtagccatagtgagggtttttagcggagcatcgctgccatacccacgcaccagatagcgaaggccagatagcccatcacgctggttgccagaggattggcttgcgagtctcgaagttgaagtcagaggcgcgcaggatgcgagcaacttgagcttgaaccttgaggtcctcttcggacatgccttgcttggcagcgagggagaccatgcagtcccagagggtttcagcggtcggacccagcggcccatctttggcctcagagagtgtcatcgaggtccaataaggaacttcctcacccttgcgtggcccggacttcatcactttcgtggcctcgtagaagaactctggggactcaaggaacgccttagcggtctccttgccgatccccggaatcccaccgtagccgtcagtgacatcgcccatcattgtctgaagcatgtggaacttgtcggcagttgcttcgtcgttcttcacgagttccatctgggttaaccagaagaagtaaccggggaccgtgttgaagtccttgtcacaactcacggagatgatgcggtcgcaaccggccaactcaggcttggtcatcaagatcccgcagacatcatcgccttccactccgtcccacttaaaggaccgctcaggaccgaagtgatccatgatgccctcgcagaacgctgggtatccgacaggcttacgcttgcccttgcggttggccttgtaggaccagaggactttcttacgccagttgtcctcacccgagatgatgcacaagtcaacgaactcatagcggtcttcggtcaacttgaacttgcgcttcagttgcccagcaatatccgctttgatggacttgatggtcccgaacagaatctgtcgagctttgttgtgatcgcagttaagcgtccagacatcaccgccccaatctacttcctcttcagccgcagacatcgcagagaagatcaggtagtccatatcgagggccaaacctactttcagaagtttgctcacacggcacctccatgttctgcgaggaactgttggcccttggtcgtcagagaccagaaccccatgttctttccagcagtggagaggcacgagatgtgcccacggcttgatgcctcgttgaccagcgcaatgcgggaccgcacgaagtcggcttgatatgcacgggcttgcttcttgatctcccagagaacttttaggtactcgttcattgggtcaccgtgaatcgcttacacagcgccgtacaggctttgtcctcaggatgcagaccgcacacttcgggcttgcctttattgacccgtggagttaccacgcagagagccggggcgaagtccttgaagccagacccaccgcactccttcataaccaactcacggacttgctttgcgctgtccttaaggaggaacgtcaggagaccatcagcgcctttctgttcgtgaagggccagcatggttttcgcaactgcaactccaccgggagcagcatcagtagggttcgctacagtgtcagcggctgccttgagaacttcctgaagatcattgagcatctcgtcgttgaagactgcgcggaagttcagggtgatgctcacgttaaaactcttggacataggtcctcctattagtggcactcgcgccatgtgtcaccgattttgaagtcggtatccagtacgcagcggaattggaatgattcgccaacctcacggatggcttgttgggaaacctgagcgatcagctctgcgatctctggggttcttgcggctatctgaagttcgtcgtgaacccaagccatgaagcagaagtcaccagcggacccgtcatctttgaaccagccgtgatacaggccatggtcctccatgagaatcctttcgacggccacaacccacttcttgcagaccagcgcaccggctgactgaaggagcgtattgagtgccgagtgggtcgagcggacgtgaaccttgcggccatccaagcctttgatccagcggcgtttccacttgacgtcgaagcgcttggtgacttggttccacttctgctcagcgacgagagacccttcgaggccctccctgaggctcttgatgactggggtgttgtccaagaaggctttcttcagtgccttcccttccttcgctcccttgccgatgatggagccgatctttccgtctcccgcaccgtataagaaggcgtagataaaggtcttcgcattcgctctccatgcctcgtggtcctcgttgtgtttgtcccgaatggtcccagcgggaaccagaccagcagccaacccgttcgcccagtgaacgtcaccctccagaacctcagaggcatacgcaccttcgtcgtaacgggccccgaagtgacccagacagcgcagctcaaggcctgacgcatcgacacccacttggcggaccttggcccacgcttcccagcccttgcgcttacgcacatggatggcaccgaagagagcgcggcaatgaggcccataaggggaactcgcggaagggacttggcccatgttcggatagctgtgagtcgcacgaccagtcaccgccccgttggggttgatgttgccgtggattgagccatcgtcgcggaccatcttgagccaagcgttatcaccttcggccaacatcccgaggcgcttctggatcatgaggtactcacggaccagctcgacgcaccgctgtttctctgggtcgtctacgcggacaccttcgagggtctcatcgtccaccactggggcaccgttgtcggtgaactcagtaggttcccagccagcatccttgaggaccttaatgaggtgcgctcggctgccggggttgaacgtgatctgctcgatgggcgtgtacggggcacctgtgacggtctcccgcttgtccagcttcccggccttcgtgaagatgtcaccgacctttgggtacttgacccgtgggtacttctccagaggctcaccagttcccggatggagaaactgagaggtgccccctttggctgcccaccatgacccgaaggtctggatcaactggaccaacatgtcctgtcggcgggccgctaactcaccatggagacgctcggcggcgtccaagtcgaacggaaacccgttgcgctccatttgggccagagtccatgcagcagcgtgctcaaggtgaaccgcttcgatgccctcgccattgttgaaatagtgagtgtcatccatgagcttgcggaacagcttcgaggtgacgcgaacgtcttgctcacagtaatcctccatcgcttggttacagacagcccactccatgccatccacatagggagtgccctcgtcttggagttggcgcatgaagtcggtcttgtactcgcccttcatctcgcccagtcgataaccccaagcttcgagagcgtgagaaccaaacatcttgccggggagaatcccagagcgaagaaggccagagtcacggtcacggatgttggagtggagcaggcggacgaggaccagagtgtccaacactttcttgcggggaatgttcaggcgcttcccgaagtacaggcgcttcagcttatcgagtacagggatgtcgtacttgatgaagttgtgcccgacaatgagaccgtcaggtttcgccgcttcttcttcgagggccttaatgtagtccgcaaagttggactcactgtaccgagtgtattgcccggtaaagtagtcctgaatggttgcgcaatggaacttcgtgacgttatcaagaagtccattcgtttcaatatctgagatgagcataggccctcctgtttaacggaaggcaacggcgctcagaggcaaccggattacctgaggtgtgtatggacgggtgttgaagttgaacgacaccgtgtagccgatgtaatgcgccgatttctcgtattgaatcgacagggccttgaagcggatgccacggaagtggttgccaccatagttggacagtgtgtgatctgccgggatgttctctgggcgaatcatgaagtccttgccaacgtaacccttaacgagatgccagttagggccagtctccatggcagacttcattaggccatgacgttcaccagcgagatacgccttggtctgttcgtccttgatgagcttcttgatggacgccgttagttcgtcctcaggctttggcgctggggcgtgccactcagggcgctcgcgttcaccatcagcccacgagtaacccatggattccaacagtttcacagcgagttcgcctttgcgcaggtgcgcgcgtacttcggaattagtcatttggtattccctcccttctacggtttggttggtttgtagaaactaaaaagccccctttcggaggctcttggatttcaacaatccgattacttttgagttggtagaaccttcgtgatccggcgatgtacgctggtgatatcgttcttgtcccagtcggcaactacgcgcttaccaacagttgcttgcagagcatcttgcgcggcagtaatggcagccttcagggaagcctcacgggccaccagcttttcatggcggcgagtttggatgcgaccagccagagccagcagtacggttacgatgtcgaagttgaaagttttcatgtggtagttctccttaatagtcggattcttgaccctgccagttggcttcggtcgtgtcggtttcgtcagcatcaggacgccagccatgaggcttagcgaccagtcggccagtacgcttgtcgtattccatgtaacccgctattccggtctccccggtgaagcggcacttcaggatgcggaacaggatcaggttcgggtttgccccttgctggttccgctccacggcgatgatcgtgtcactcagttggcgaagtccgcccgagcctcgcaggtcagtcgccgttaccggacgcccttcctcgtgtggcttgcccttgtcagggttcttcaagtgacagatcacgaacacagccacgcccttgctcttggcgaaggacttcagcttggtcatcagacggtcgatggtcttgcgctcatcgttatcaccgtccatggcagacaccacgattgagatgtggtcgaggacgatcaccttgcagccctcagcggccaccatgtagcccagcttggctaacaggcgatcctcagcggcctccgcaaaggcgtcatagaggaacagccggtcagacgcaaagatctcgtcaaaggctgcgtcaaacatctcctccgtggtctcatcggggttctgacggactcgtgagcccatgtgaagcccaacgatgtcctgtacggtttcctctacggcctcctccagcatcgcaacaccgcaggggatgccctcgttgtggaacaggttgtagacgttctgccgaacgaaggtggacttgccagagccggaaccagaggtgaccagaatgacctcaccttcccgcacatccttggtcatctcacggagttcatgaggtgcttccagaggcatcgaggggatgaccttcttttccttgatgcgggccttcagggacttcgcggataccacaccatccgggatgaatggtgaggcgttccagatctggtccgtgacggccttcgcattgcctttctggacgcattcgttagggtccttgaagggcaacacagcgattttcaccttgcccggagggagaacctcagcggcctcctgagaggcgaggcggcccggctcatccatgtcaaacatcaggatgatctcgtcgaactggtcgaagtattcgtagttcgccgcgcaggtcttcttggcagccttcgagccgtgcccgatggacaccactggatacttaccgccctgcaactgagccacggtcaggcagtcgatctcaccctcagtgacgatgatcttgcgaccaccattccagaggtgacggccaaacaatgcttccttcgagtggtcacccttggtgcagaactccttggacgcatcgcggaccttctgggattgaaggttgcccgcagagtcgtagtagttcgccacttggacaggcaccaccttaccagtgctcggtgtccatgccttgcctacccagtagccatagaggcgacagatggactcttgcaggaaccttgcaggcaggtcttggtagcgcccttggcactcgctcattagcagtgtgtcggcgtgccgggtgatctctcggttacctgtgcctcgctccttcccatcgggggccttgtaggcttcctctggagagcaggcgaaacagtattggtgaccatcggagaacagtgagttggcgtccgaggacccgcaggtctcgcaggggatgtgctgaatgaagacactttcttctctgtcttcactggacgacatcgcgtagctcccgctcgccatgcttcaggcccatctcgccattggcaggacggcccagcacgaggtcgagccacttctcttccatcttcgcctcacgggacccacgagcgtcctcacggagccttacaagcttgctccaatgctcagtgcccatgtaacgaatagttgccccgtcgatgccccgagggatgcccacgatggcgaactggttgaggttgtagtcgaacttgccgatggcctcgtagacacaatcggtctcgtaaaggatcacgtcgatgttcgagccttcgagcttccagacaccttgcaggcggtccgagtcggaacctgtgtggtacttcgggaacttctcgtagacgaaaccaccttcatcgagcgctctggaaacagtctccgggtcagtgcccgcgcagatgatgtcgatgtctttggggaccactccgaagaacaggtcacgggcacagccaccggcgatgatcgcgccaatgccatgttccatgagatgctcaacgaggtcgaacccaccttgcagtagggaacggttcatgatgacctccataagtcaaacgcaaaaaggccacaaagaaccgttaaggattctctgtagccacagtgagggtttttaaatcttcagccagcgcttgacgtcgaaggacgggcaggctttgccagagtcgaggtcgcggtgaccacaaatcttggcggcagggtagagcgcttggaccttctcaaggagggtcttcaggctcgcatactggacaggcgtgaagttgtcttcaggcttgcccttgtcgtcgataccaccagcaaggcagatacccagcgacacagcatttttgcccttgacgtgggacccaatgaccccatgagggcggccttcttctacggtcccgtcacggcggatgacgaagtgataaccaatgtcgagccagccttgctggacatgccattgacggatctcacggacaccaatgtccatggatgccttggttgcagcacagtgaacaacgatcaggtcagtgtgggtgcgctccttgaattggactttgggcattacttacctcctttcggaacgagaatcccctcagggatctccttgcgtacctccttgagccaagccaatgggatcagcttgtcagcgaattgaatcccgtgtttacggcagaagtctgcatagctcgttggggagcccttgtagatcttgctgttggaattcgagaagaccagacggatgtcgagggccgggtattgctcacgaatcagcaagtgtttcttgcggtcgtcaacctcccagatccctttagtctccacgatgattccgttgcgtagaacgaagtcgggggtgtatttggccttgcgggccggaacgatgtactcgatgtggaacagctcgaagtcgaaggcgaccccaagcttgtccatatgtttcgcgttgcggtcttcgaggccagaacggaaggcacctgtacgggcgcctttaggaccggcataacccatggttagaagtccacatcgtcgtagctggtgcgctcaggcggcgtgttgtcgctgtcctgttcaccctgccagccttgctcgcggtcatccggggcctcatagccttcctcggtttcttctgcccagtcatcaccaccagcgccgtattcgaccagcttgatgagcatgatggagtcgagttgcagcttgaccgatgcgcctgccacgttgctgaagctgtatgggaacagcgagaaacgggcttttagttcggagccaccagagatggccggaacggcttcgatgcgcttgcccttggcatccacgacacgcagaacgatgtccttggactccttggtcttgctgtcgatgtacgaggcgtaaccagccagcttgaaggtcacagtgccgtcatcgttctcgaagaacggaaggttgccctgatagggttccagcaggaccttgccgcgttgcagcttggcacgagcagcggcctcgccaccgttcttccattccttctggatttcacgccagttggcttcctgagcctttacgatctggtcgatcagtggttgcgcttcggcgcttggcacggtcaggttgaccttgtagacaccacgaggattgccgaagcccttctcggggttgccgtagtcaggcttttgcagcgagcagtagggctcagcgatgcccttaggggtgaagaagaattgtttcttgaagccagccatgggtatatctcctatacaagtgggaagtttgtgtgtagccacagtgagggtttttaaatcagtaggtcagcgactcgcgctctgcgatcagcttgtcagcaaagtcctgaatgaccggctgtttggtgatcttggtaaaggcgtggacgacctcacggaagttggccttcaggaagtccttgcggaacctcacagtgccatgcttcatgtggtagttggactcggtacggccctcatagatggccttgaggttcgcctcactggcgcgcagcaacaacaggcggtctacggtctcacgctgttcatcgtcaaggatgtgcgtatagaccacagcggcaacaccggacgccttagttaccgtgaagttctggatgtgcaggaagccgtctggcatcgagcgaggtttgccttgagcgtgtctcattgagccacctccgggatcacctctgggcgaatccggcgaacgttgtcctcaccgtactcaaggtcagccgcgtcgagggcctcctcgatagtacgggcgtacatcggaacttcttcggcgttcggacccaagttaacggtgaccagaaacttgcgcatcttttggttttcgaggttcattattcaattactccttgatctttaagttgcttgagcatgtcgctcgcaaagccccagcggttttccacatgggcgttcatgatgaagtcgcgcagctcggtatcggttgcatgcagtggcgcagagtccacctctgggatcacccagttgcgggtcaggcgaacgtgatgagccccgaggttctcaagggcgtcatactcgttggcttggcgcatgtcggtgacgaccactacggcaccctcaggggccttggcgatctctttgagaccctctcgcagccacacatcagggtccttcaggaagttgcggcggtagccggttccgtattgctgaaggtgccagcgaggcgagcggggccgtaccagttcctccgtggacaggaggtgtgggcctccttcatcgagccagcgcgcatagtcactgtctgggatgttgatagcggccaattcctcaaacggcgcgtccttgaggtcactatgcatgtgtgactccatgacaatccgggccttcccgttggaggtcaggacctcggcgcattggcgcttgagaacgtccccgaaggcgacccggtagacctcatagccatcctcgcggagcagctcaacgagggtgtctttgccgctacggccacgctcagaggtgagggcgatgatgacgttggtcatttggacagctccatgaagaagtagaaggcgttgacaaccagcacggcgaacgacaaggcgttgaaccatgggttatcgatgaggccccgcagggacgttcctacgcgctgccagaagtcggcctttggcgttggggcttgctcggtgaagcgaggaccacggctatggaacacagcgaggttccgttggcggtcgatgttgctctggtgcaggcgatgggcaaacgaacggtctttcatgttggttctcctgtgttgggttggtggatagccacagtgagggtttttaattccgcagctttctctcgatcagtagagcgaggtccgcagagatccctataaggagcacgaacaccgtgagggtcgcagcgatgcctattagaatgtcgagcatgatagatttctcctattgttacaggcacaaaaaagccccaccgggttagggtgaggctcgttgagttgcttgaggatcagccgcgaatcaggcagatcagcagggcgacttgggtgatgaggattgacaggacctgataccacgtcatggtcatgatgttactccttgatgtacgggtcagagatcccccggaactcgtcgaaacttgggtgccgcattgagccatcggggtagcgctccatgcactttacacgaaccgtgaagccttcgtaagggttaatgccagtggagtagccagcggcaaggaccgcatcgaggtacgcatcagtgaactcatccatcagcttgcggctgatcttgcaggcgttgaccacatggccggactcaaggagaacctcgaagccgatcaccttgccagcgttggcgagaccttcagtgccccagaccagacccacgaccttaccgtcttcgttgtcgctcgggaccatcttccaccaaccagaacacttggagcgtctgtagtagcccatagggtccttgcagaccagtccttcctcgccacgctcacgaaccgcagtgaacagctcagtgaggctcagtgggcgctcgcattcgatctcgttgccctcggcgtcaacctcgtggcgctctgggagggcctccatggaaaacacatcgtaggtctcagcaacccgccagtcgatctcgggaaagtattccttgagcttggcgacttggtactcaacgtggcccttacggacgcactgcatgacatcgtattcgatgcccagcgcgatcacgtccagaggaacgatgtcgaacacgtagacccggatgcggtccatgggaaccggcttgtccttgcggcgcagcgtaccagaggtgtccttgcaggcaccctcaccgcccaagctgtccagcaggatcagttcagcatccagcatgaagccctcgtcattgaacagagcttcaccgatgtgcgggttatagaacttcgaccagcgtgcatcgccttgcaggtactggatcagagccgggaagcgcttaccctcacgggacagccactctacgttgaccactgggtcccggccagacacgcacaggttgagacgaacgccatccttcttcacgtcgcaggtcagataggactcgtcgagcatggcctgcatggctttctcgttgaagtctgtagggcggaacggcttggtgttgaggatgacggcttcgactttggacatggtgggttccttatttgatgacggttacgtctgtgatgtaggagtgcgggactatgtggatgccgcatttaccgctaactcgatccttcaggacctcgatacaggccatgccgggttgatcgacaacgacgagggacacgattcgatagatcagcgaggcgcgctcgcttgcttggcggttctcgtagatgttcacgctgtcttctccgaggttgcctttgtggtgcgggccttgcgggtcttcttcacgggctctttcggggcctcgtcgaggaccatcaggtcagccttcacgcccttgagtggagcggtcacctcgaccacttccggctccggtcggtcctgcttagcgagggtctcgaagtgcaaccgaacagccgtctcggtcatgcgctcggcaccttggcgcagggcctcaatgcgttcttcgagggtccctgcgagatagcggttttccatcagctcattgactgggtagccgacacgttgcttggtgacgttcccggcgatttccacagaggtctcgatgaggaccgtttcggcgtccaccatggacgaggtagatttgatgatgacttccatttagatggtctcccattcagtgcgctgggcgcgattggctttgttgagtttgcccttacgagcgcggaccacttccatctcggactcttcacggcgcggagcggtcttgcgggttttctcgaagttcattgcggagttcattatttggttcctcttatgcgaaggcaaagtcagatttcaggatttgggtgatgtcgagtgttcccttggccgggatctctggcatctttgaaagttggctaacgtgtagttgctccatgaattgctcacggaagtctgcaagtacatcgttgttctggtatgtctcaaccattgtttcgcggactgcccggaacatcgccccagcttttgccgggatagtgccgaacgagtcgtgtattagtgcgaagaagtccaagccgtatttctcatggctccacactactgttttgcggaggtgcgaaccgtcctgagagtggacgaagttcggagagatacccgattcttgtttccgggcgtcaattacatcgctatcccgtacagtcaccgttgattgcaggcggatgtccccgaggaacatcaggtcaatccggcgagtctctgggaccatgtattcctgccataccgggaagccgtcaggcgtggtccagtaaacaggcattgcaggcttgagaatgaccttcttgtccttcttgtccttgacttcagatgacagcaacttagcggccttctgtagccagttcatcgcctctacagcagcgactacaacgacactcaccgagtcccagataagaccagccatgaagcggctcgcctgacccacatcggtgaacatttgaccctcaccgttatcaatcgctttcttcacgatgtcatcacggacctgatcggtgaacccgtaggctttcgagccgtaggccagagtcatcacggaccgcttggtgacctttcgggacatcccgtaggccagccatgccatagcgagggtttttgttccgaggatgagtttctcagtgatctcgccggtcgtttcgtcaacgtagatctgcgtggagttctccgttccggtctcagcgaggacctttagggcctgctcgacttcatcagagacgagcttgtagatgtcctgcacggaatcgctgggaagcaggttgacagctcggccaccacgctcatctcgcagcattgcagagaagtgttggatacccgaacagctaccgtcaaaggcgataggcagcgcgctaacgtgtgcagctccgtctcgctgtaccccttcccactcaaagcagaaagcaaggaagcaaaatggggagtccatttgcatccattcgatgttgttaagtgggtcatttgcgcacctcagaatcatgtcttcgttgtcgagaacccattgacggcgctcattgaaatcaaccttgtccacgcctgccgtgttggcaccatggatcatcagccagccaatcccttcgtccccgatgggttcccctttagcggcctgcaagatccccttggtcatgtcgttggactgagggttgaacacagggatcgcgtagacccggccccgccagtcgaggttatacgggaagtaaatcgcctcgaagtccttgaacttgttggcctgctcgatggtgaactggtaagagatcctacgagagacccgagcggcgtccttgcggtagaccgcagaggctgcctttttccagtccttgagggcctcttcgttggtgtcgatgtcccaaggcttgatcggcaaaggttcttgctcgacccgtgggaactccttgatcggcacgttggcccacgtcatgacgctgttcgccacttcgaggacgcgcttgttgatgctccatgcggtgttttgagcgaggttaacggccttgtagacctctggcatgtgaacgtcgcggtagcgcttcagggctcgcttggagcggacccggatgaacgtcacaggcttgcgccccttggcccagtagccgccaccgtgggtcccttgccatggcttgggttgcacgaccatcggctggtagcgcggaaagacaccttgcaggacgaaggcccgagaggtcagcttttcggcccattccggcttaaggtagatgtactccccgtcaagctttttgttgcctttgtgctcacggatcatctcgatcaactgcgtggactcgatgaggagttccagcatgcggacacccatgtgatacaggatgtcgggcgtgttagattcccacggctgccaattaccgttgaccttgccgtccttgaccatctgggcctcgatcttcgccatgtactccagcttgtaagtcatcccattgcgttgggcgagggacttcttgaggtgcttctggtagtacgactgttccgctgcccggatgcgaccatagcggcattcttcctcaagggctcccccgagggacacagcgagttcagttacggtcggtgcgccatcacgttgggcaatccggttgatgacaatgcggatgacaatggatgccatcacatcagggttcatcatctggaaagcgccgatggccacatgcttgcgccggaccttcgtgacttggtgttcgatccagttggagatcgccgtggagagcagcggaacgagggtcccgaggagaggcttggcgacactgttgctggagaactcgccccggtcttgagcacgctcgaaggcatcgcggaaacgatcttcgcccagtgtgtaggcttcgtgttcaagctggagttgctcagcggccagctcagggccatagatcatggacagcgcgttgaaggcttcggcagaggtgatctcgctgaagtcttgacgttcaggcagttgaaacatctttaagatctctataagaagaatgaatctaataggaatggtctattagtcttctctgagaggtcctaaagagatctttaaggaacggccctcagagtgtcatagccacagtgagggtttttaaatccgtgccttagcgtgttgcggtgatacgccctacaatgtcgtcgatcttgtagataaactctttgatttcgcgttgatcctcgatggccttgatgcgacccttgatgaccgccagttcggggctgttgaagtacatgaatcgacaccggctgtgtgggtgcagcgccttgtgttggcgataaaggttgtcttggatggtctcggcggtctcgtagagatggccca

SEQ ID NO: 11 - DNA, 39673 bp, unidentified
  misc_feature 1..11: note = bacteriophages nucleic acid sequence
  source 1..39673: mol_type = genomic DNA
gtgactaaaccgactgatgatctcaaaaggatcaaacagtcattcgttctattcctgttcgtactgtggagagcactcaatctacccaaaccgaccaagtgtcagatcgacatggctgcaaaactttccagtggcgaccaacgccgctttatccttcaagcatttcgaggtatcggtaagtccttcatcacatgcgccttcgtcgtgtggaagttgtggaacaatcccgacctcaagttcatgatcgtgtccgcttccaaagagcgggcagacgccaacagtatcttcatcaagcgcatcatcgacctgctcctgttcctgcacgagctgaaacctcgggtcggacaacgtgactccgctctggcgttcgacgtgggaccagcaaaacccgaccactcaccctcagtgaaatctgtaggtatcaccgggcagcttacgggttcccgtgctgacatcctcattgcggatgacgtggaggtcccgaacaactctggaactcaggccgctcgcgatcaccttggcgaactcgttaaggaattcgacgcgatcctgaagccgggcggaacgatcatctatctgggcacccctcagaccgagatgaccctctaccgcgagctggaaggccgtggctacgtcactacgatctggcctgcgagataccctaaggaccaaacagatctcgactcgtacggcccaaggctggctcctatgctcgccaaggaactcgaagatgacccaaggctttactgggctcctacagaccctgtgcgattcgacaacgctgacctgaatgaacgggaactgtcgtatggcaagggcggcttcgctctccagttcatgctcaacccgaacctctccgacatggagaagtaccctctcaagctgcgtgacttcatcgtggggtcgtttgatctctcgaagggtccaaccctactcacatggcttccaaacgccgctaacgaggtcaaaggggttcctctggtgggcctcaagggtgaccgcttccatcgctatgagtctgtcggtcaggccatggctgagtacgcccagaagatcctcgtcatcgacccctcgggccgtggtaaggatgagaccggctacgcagtcctgtaccagctcaacggctacatcttcgtgatggacgctgggggcttccgtggtggctatgaggacacgaccctgcaagcccttgcgaacatcgccaagatctacaaggtcaacgaggtggtcattgaaggcaacttcggtgatggtatgtacgtcaagctgattagccctgtgatcgccgccacctacccgtgcgctgtcactgaggtcaagtccaagggtcagaaggaactacgcatctgcgacgttctggagcctgtattgggctctcacaagctggtactcagtgaggccctcatcgacaaggactaccggaccgctctgaacaacgacggaaccactgacacctcctacagcctcctctaccagcttacacgcatcactcgggagagaggcagccttgctcacgatgaccgtctggatgcccttgcaatcggcgtgcagttcttcgtagaggccatggagcgcaacagcgtgaccggcgagcaggagatgcttcaggagttccttgagagccaccttgagaacgctatgagcggctgggaggaaacccggcagatgtccatggctgattccctcacgattcagttcgaggatgacggcagcatgagcaacttcatgggctggtaaagtgtgaccggatagggatatctggtcattatcagcacgaatttaaaaaccctcactatggctaccgtagggggtcctaagtgattaaagcttagagatctccttcgggcctcatgagcatcatgacctccgaaggcatcgaccctcgctctcttaggtcaggtgttaatggcaatagccatcacccatcaaaggagaccagtaaccatgaacgtagagaaggccactgtgctgctcgtactgaagcggctggctctctctcgttccacctacaagctgctcggccttatcctcgttgcctctggcttcgctcaagggtccgaagtcatgtcatgggcctcaaccctgatctgcgttgcatctggtgggtgcgctgattgacagacgcgaggctcaatttcggcagtgttagcacactacctcattgagctgtgagagcaacccttaatgaacaccctaatgactggtcttactggtcctcagggtattcgttaggataaccgatagaaggtattgactctggggatcgttagggtatcctaatgggactctttgagaatctgagagaaaaatctgagagagcacctctcatggacagacaccgagattacccccgtaggggccctctcagtctactctaagccacctcatccccacatgggctcgttgagatacctgcctgatccctcaagggcatctcatggggatcattatgggccgataggcatgaggtgtacaatgagtattcgctatgggttcttagagggttcatagggaatctctatgtctccgtctgtctctatctgttgtgtccctaatgggctccttgggtaaccactgagggctcctaatgctcaccactgggccatgctcctaatgaacccaaccagacgaacggtaagaccctctacaagctcctcagaggctctcagggacacgttagggccaaaggtaggccatggcatagggtagtagtctatcgttgctaatagcctcaagcccttgatctataaggctttcagaggtgctctttgatcgattggtcaggttcttggctacaatgctgttgttctatccagtattgaccactgagggtctataggttatccgcgtgtgcgcccgtttcgttaaccattgagggaccattgagaatccataggacactggatgaataaacaggtagacatgcctcaattcatggtgtctaatggctcccatcaacggcaaacactgagttgatcgccacggtcttcggccttggcctctgaggtctcattgagatgaccaaagggactgacaccgaggacctacagggcacagtctgggtcgggcaatacttcgagttaccctaaagactgctgagaaacaaacgcttgacacgatgtacaaacgctgtagaatacgcaacatcaacaacgattaaccgaacggatgtcacgagtaggttggtctacgaaagcgcagaacaatagcggtcttccagacgctaagcgctacccttcaggctgtcctcaggacgaagcacgggagaggtacgcactgaaacaaccgctctttaacaacttggaatgtaacacctgccttgcttggtagcctcaagcactccgaacgcattggatgcggctggtcgggagaggatgcaaggcagtagtgaatagggtaatgaactctcgtgtaacccaagcattgagcacgagccaaaggagagttcatgtccgtatccacaccgcaacacaacagctaaggaagctgaccatgagtacaagaaccaaagccctacaggacgcacttgacgatctggcagtacgcatcaaggccgcaaaggatgctcaccaatccgctaagtcaacctttgggcgctttgaaggccctcacagccatcccatgtggttatctacagggttcgagcgggtcaggaaccaacatgggaacgggtcggcaagttctggttggtctacgggaactccgctgaggatgtcattgcggactacggctcactgaccgggcttgaatccctgttctcccgctggttcgacgaggcaacgcaagaagacgagtgacatgattcgctgctgggtcttcccattgaggacccatcgggaacacatcaccaaccatgagtagtacatcatgatccatccgcaacgctacaaccggaccaacttcgtgtccaacacagtcgccgccaaaatcattgaagcgatggacactgcattgactgacggtcttcagcactatgtcaccaacaagcatgagcaacgctggttgcgtgtctgcatcaagccggtcgaaggatcggttggtcagttcacctatgagttcctcgctgggaacggtcaagacgtgggccacttgatcctgcaagccatgttcgtgtggcctgcccatctggaacgtgcgttctcccagttgagcgccgaactctacaccaaggccgaacacccttacaagacctttcgtcaggttgtcattaaagaacttgaggatgctgccgaggatgcacgccgggaggccgaggcggtcaagcgccgtgagtacctcaagcgcatcggggcgacccactctttccgtacaccgggaggggtcacgttcctcggtcgctacgtccgcaactggttaggcgtcaagggcttccttgcgatggcctacaaggacggtgcgcggctgccccatgggtcattcaagctgtcccgtgaagcgttcctctacggcaccacacaggggcttacagcatgagtcgagtatttaccaaggcgaccacgggcatcgccagcgcggacaagtaccatccgttgctaaagcaacacctcggggctctcaaagagatggcccggtacagcgaggagaatggcggggtctgccctgctgacgtgctcgcgcgcgatgacttcgcggagttccttgaggactgtgtggtctgccatgcgccgggggtttactccgtggcgtacctgcacccagcttactgccgtgacattctccacgaggtcgccaagttcccctttgtgccgaaccttgaggaacccttggaagcccagattccagaggtcgtcctacaacaggaacatccggtgttcttcgaggttttccgttcgttctggcatgacgcaggactggcctataccaaggcgctgttgaaccttgagccggacaacctgacgagcgtccaagcggccctctataagccctcagagactccacgaggccattggcacaacgaccaagactcagacgttactctggtggtcgcgctcaatgacgacctcaagggaggtggaacgatggtccataggggaccctttgtgccgcccgtcaaggtggagcagaaccttacaggctggggaatgctgttcctcggcaaaacaacattgcactacgggttgccagtgatcgagggcgaccggaatctgcttgtccattggagtgaactgaagtgatccatacaaactaccaaccggcccgaaagggcctttttaatgcccggatttcggcggaaaaggctgctgcattgggagcgacgatgcgcaacccggatagtaagcacacggtcatggggaccctttacggctccgctaagcaccctgaggttctggtccgtgctgttgcttaccctgacgagatcgaagcgcgccacgcactgttctacagcgaccggggcgacttcacccgctgctaccggggagggttctaaatgtccctcaagtcattggaaacatgccggtccattaagttcctctccatggtccctaattttcccgatccggtagcggtcgagtttactaccgggttcggcccatgtgggcggcatgtacagagtctgacctacgaggtttccgaaaggttcctcaaagtcacacaaatttctcacccggttgacgatctgggccatctctacgagaccgccgagaccatccaagacaacctttatcgccaacacaaggcgctgcacccacacagccggtgtcgattcatgtacttcaacagccccgaactggcggtcatcaagggtcgcatcaaggccatcgaggatcaacgcgaaatcaaagagtttatctacaagatcgacgacattgtagggcgtatcaccgcaacacgctaaggcacggatttaaaaaccctcactgtggctatgacactctgagggccgttccttaaagatctctttaggacctctcagagaagactaatagaccattcctattagattcattcttcttatagagatcttaaagatgtttcaactgcctgaacgtcaagacttcagcgagatcacctctgccgaagccttcaacgcgctgtccatgatctatggccctgagctggccgctgagcaactccagcttgaacacgaagcctacacactgggcgaagatcgtttccgcgatgccttcgagcgtgctcaagaccggggcgagttctccagcaacagtgtcgccaagcctctcctcgggaccctcgttccgctgctctccacggcgatctccaactggatcgaacaccaagtcacgaaggtccggcgcaagcatgtggccatcggcgctttccagatgatgaaccctgatgtgatggcatccattgtcatccgcattgtcatcaaccggattgcccaacgtgatggcgcaccgaccgtaactgaactcgctgtgtccctcgggggagcccttgaggaagaatgccgctatggtcgcatccgggcagcggaacagtcgtactaccagaagcacctcaagaagtccctcgcccaacgcaatgggatgacttacaagctggagtacatggcgaagatcgaggcccagatggtcaaggacggcaaggtcaacggtaattggcagccgtgggaatctaacacgcccgacatcctgtatcacatgggtgtccgcatgctggaactcctcatcgagtccacgcagttgatcgagatgatccgtgagcacaaaggcaacaaaaagcttgacggggagtacatctaccttaagccggaatgggccgaaaagctgacctctcgggccttcgtcctgcaaggtgtctttccgcgctaccagccgatggtcgtgcaacccaagccatggcaagggacccacggtggcggctactgggccaaggggcgcaagcctgtgacgttcatccgggtccgctccaagcgagccctgaagcgctaccgcgacgttcacatgccagaggtctacaaggccgttaacctcgctcaaaacaccgcatggagcatcaacaagcgcgtcctcgaagtggcgaacagcgtcatgacgtgggccaacgtgccgatcaaggagttcccacgggtcgagcaagaacctttgccgatcaagccttgggacatcgacaccaacgaagaggccctcaaggactggaaaaaggcagcctctgcggtctaccgcaaggacgccgctcgggtctctcgtaggatctcttaccagttcaccatcgagcaggccaacaagttcaaggacttcgaggcgatttacttcccgtataacctcgactggcggggccgggtctacgcgatccctgtgttcaaccctcagtccaacgacatgaccaaggggatcttgcaggccgctaaaggggaacccatcggggacgaagggattggctggctgatgatccatggtgccaacacggcaggcgtggacaaggttgatttcaatgagcgccgtcaatgggttctcgacaacgaagacatgattctgaggtgcgcaaatgacccacttaacaacatcgaatggatgcaaatggactccccattttgcttccttgctttctgctttgagtgggaaggggtacagcgagacggagctgcacacgttagcgcgctgcctatcgcctttgacggtagctgttcgggtatccaacacttctctgcaatgctgcgagatgagcgtggtggccgagctgtcaacctgcttcccagcgattccgtgcaggacatctacaagctcgtctctgatgaagtcgagcaggccctaaaggtcctcgctgagaccggaacggagaactccacgcagatctacgttgacgaaacgaccggcgagatcactgagaaactcatcctcggaacaaaaaccctcgctatggcatggctggcctacgggatgtcccgaaaggtcaccaagcggtccgtgatgactctggcctacggctcgaaagcctacgggttcaccgatcaggtccgtgatgacatcgtgaagaaagcgattgataacggtgagggtcaaatgttcaccgatgtgggtcaggcgagccgcttcatggctggtcttatctgggactcggtgagtgtcgttgtagtcgctgctgtagaggcgatgaactggctacagaaggccgctaagttgctgtcatctgaagtcaaggacaagaaggacaagaaggtcattctcaagcctgcaatgcctgtttactggaccacgcctgacggcttcccggtatggcaggaatacatggtcccagagactcgccggattgacctgatgttcctcggggacatccgcctgcaatcaacggtgactgtacgggatagcgatgtaattgacgcccggaaacaagaatcgggtatctctccgaacttcgtccactctcaggacggttcgcacctccgcaaaacagtagtgtggagccatgagaaatacggcttggacttcttcgcactaatacacgactcgttcggcactatcccggcaaaagctggggcgatgttccgggcagtccgcgaaacaatggttgagacataccagaacaacgatgtacttgcagacttccgtgagcaattcatggagcaactacacgttagccaactttcaaagatgccagagatcccggccaagggaacactcgacatcacccaaatcctgaaatctgactttgccttcgcataagaggaaccaaataatgaactccgcaatgaacttcgagaaaacccgcaagaccgctccgcgccgtgaagagtccgagatggaagtggtccgcgctcgtaagggcaaactcaacaaagccaatcgcgcccagcgcactgaatgggagaccatctaaatggaagtcatcatcaaatctacctcgtccatggtggacgccgaaacggtcctcatcgagacctctgtggaaatcgccgggaacgtcaccaagcaacgtgtcggctacccagtcaatgagctgatggaaaaccgctatctcgcagggaccctcgaagaacgcattgaggccctgcgccaaggtgccgagcgcatgaccgagacggctgttcggttgcacttcgagaccctcgctaagcaggaccgaccggagccggaagtggtcgaggtgaccgctccactcaagggcgtgaaggctgacctgatggtcctcgacgaggccccgaaagagcccgtgaagaagacccgcaaggcccgcaccacaaaggcaacctcggagaagacagcgtgaacatctacgagaaccgccaagcaagcgagcgcgcctcgctgatctatcgaatcgtgtccctcgtcgttgtcgatcaacccggcatggcctgtatcgaggtcctgaaggatcgagttagcggtaaatgcggcatccacatagtcccgcactcctacatcacagacgtaaccgtcatcaaataaggaacccaccatgtccaaagtcgaagccgtcatcctcaacaccaagccgttccgccctacagacttcaacgagaaagccatgcaggccatgctcgacgagtcctatctgacctgcgacgtgaagaaggatggcgttcgtctcaacctgtgcgtgtctggccgggacccagtggtcaacgtagagtggctgtcccgtgagggtaagcgcttcccggctctgatccagtacctgcaaggcgatgcacgctggtcgaagttctataacccgcacatcggtgaagctctgttcaatgacgagggcttcatgctggatgctgaactgatcctgctggacagcttgggcggtgagggtgcctgcaaggacacctctggtacgctgcgccgcaaggacaagccggttcccatggaccgcatccgggtctacgtgttcgacatcgttcctctggacgtgatcgcgctgggcatcgaatacgatgtcatgcagtgcgtccgtaagggccacgttgagtaccaagtcgccaagctcaaggaatactttcccgagatcgactggcgggttgctgagacctacgatgtgttttccatggaggccctcccagagcgccacgaggttgacgccgagggcaacgagatcgaatgcgagcgcccactgagcctcactgagctgttcactgcggttcgtgagcgtggcgaggaaggactggtctgcaaggaccctatgggctactacagacgctccaagtgttctggttggtggaagatggtcccgagcgacaacgaagacggtaaggtcgtgggtctggtctggggcactgaaggtctcgccaacgctggcaaggtgatcggcttcgaggttctccttgagtccggccatgtggtcaacgcctgcaagatcagccgcaagctgatggatgagttcactgatgcgtacctcgatgcggtccttgccgctggctactccactggcattaacccttacgaaggcttcacggttcgtgtaaagtgcatggagcgctaccccgatggctcaatgcggcacccaagtttcgacgagttccgggggatctctgacccgtacatcaaggagtaacatcatgaccatgacgtggtatcaggtcctgtcaatcctcatcacccaagtcgccctgctgatctgcctgattcgcggctgatcctcaagcaactcaacgagcctcaccctaacccggtggggcttttttgtgcctgtaacaataggagaaatctatcatgctcgacattctaataggcatcgctgcgaccctcacggtgttcgtgctccttatagggatctctgcggacctcgctctactgatcgagagaaagctgcggaattaaaaaccctcactgtggctatccaccaacccaacacaggagaaccaacatgaaagaccgttcgtttgcccatcgcctgcaccagagcaacatcgaccgccaacggaacctcgctgtgttccatagccgtggtcctcgcttcaccgagcaagccccaacgccaaaggccgacttctggcagcgcgtaggaacgtccctgcggggcctcatcgataacccatggttcaacgccttgtcgttcgccgtgctggttgtcaacgccttctacttcttcatggagctgtccaaatgaccaacgtcatcatcgccctcacctctgagcgtggccgtagcggcaaagacaccctcgttgagctgctccgcgaggatggctatgaggtctaccgggtcgccttcggggacgttctcaagcgccaatgcgccgaggtcctgacctccaacgggaaggcccggattgtcatggagtcacacatgcatagtgacctcaaggacgcgccgtttgaggaattggccgctatcaacatcccagacagtgactatgcgcgctggctcgatgaaggaggcccacacctcctgtccacggaggaactggtacggccccgctcgcctcgctggcaccttcagcaatacggaaccggctaccgccgcaacttcctgaaggaccctgatgtgtggctgcgagagggtctcaaagagatcgccaaggcccctgagggtgccgtagtggtcgtcaccgacatgcgccaagccaacgagtatgacgcccttgagaacctcggggctcatcacgttcgcctgacccgcaactgggtgatcccagaggtggactctgcgccactgcatgcaaccgataccgagctgcgcgacttcatcatgaacgcccatgtggaaaaccgctggggctttgcgagcgacatgctcaagcaacttaaagatcaaggagtaattgaataatgaacctcgaaaaccaaaagatgcgcaagtttctggtcaccgttaacttgggtccgaacgccgaagaagttccgatgtacgcccgtactatcgaggaggccctcgacgcggctgaccttgagtacggtgaggacaacgttcgccggattcgcccagaggtgatcccggaggtggctcaatgagacacgctcaaggcaaacctcgctcgatgccagacggcttcctgcacatccagaacttcacggtaactaaggcgtccggtgttgccgctgtggtctatacgcacatccttgacgatgaacagcgtgagaccgtagaccgcctgttgttgctgcgcgccagtgaggcgaacctcaaggccatctatgagggccgtaccgagtccaactaccacatgaagcatggcactgtgaggttccgcaaggacttcctgaaggccaacttccgtgaggtcgtccacgcctttaccaagatcaccaaacagccggtcattcaggactttgctgacaagctgatcgcagagcgcgagtcgctgacctactgatttaaaaaccctcactgtggctacacacaaacttcccacttgtataggagatatacccatggctggcttcaagaaacaattcttcttcacccctaagggcatcgctgagccctactgctcgctgcaaaagcctgactacggcaaccccgagaagggcttcggcaatcctcgtggtgtctacaaggtcaacctgaccgtgccaagcgccgaagcgcaaccactgatcgaccagatcgtaaaggctcaggaagccaactggcgtgaaatccagaaggaatggaagaacggtggcgaggccgctgctcgtgccaagctgcaacgcggcaaggtcctgctggaaccctatcagggcaaccttccgttcttcgagaacgatgacggcactgtgaccttcaagctggctggttacgcctcgtacatcgacagcaagaccaaggagtccaaggacatcgttctgcgtgtcgtggatgccaagggcaagcgcatcgaagccgttccggccatctctggtggctccgaactaaaagcccgtttctcgctgttcccatacagcttcagcaacgtggcaggcgcatcggtcaagctgcaactcgactccatcatgctcatcaagctggtcgaatacggcgctggtggtgatgactgggcagaagaaaccgaggaaggctatgaggccccggatgaccgcgagcaaggctggcagggtgaacaggacagcgacaacacgccgcctgagcgcaccagctacgacgatgtggacttctaaccatgggttatgccggtcctaaaggcgcccgtacaggtgccttccgttctggcctcgaagaccgcaacgcgaaacatatggacaagcttggggtcgccttcgacttcgagctgttccacatcgagtacatcgttccggcccgcaaggccaaatacacccccgacttcgttctacgcaacggaatcatcgtggagactaaagggatctgggaggttgacgaccgcaagaaacacttgctgattcgtgagcaatacccggccctcgacatccgtctggtcttctcgaattccaacagcaagatctacaagggctccccaacgagctatgcagacttctgccgtaaacacgggattcaattcgctgacaagctgatcccattggcttggctcaaggaggtacgcaaggagatccctgaggggattctcgttccgaaaggaggtaagtaatgcccaaagtccaattcaaggagcgcacccacactgacctgatcgttgttcactgtgctgcaaccaaggcatccatggacattggtgtccgtgagatccgtcaatggcatgtccagcaaggctggctcgacattggttatcacttcgtcatccgccgtgacgggaccgtagaagaaggccgccctcatggggtcattgggtcccacgtcaagggcaaaaatgctgtgtcgctgggtatctgccttgctggtggtatcgacgacaagggcaagcctgaagacaacttcacgcctgtccagtatgcgagcctgaagaccctccttgagaaggtccaagcgctctaccctgccgccaagatttgtggtcaccgcgacctcgactctggcaaagcctgcccgtccttcgacgtcaagcgctggctgaagatttaaaaaccctcactgtggctacagagaatccttaacggttctttgtggcctttttgcgtttgacttatggaggtcatcatgaaccgttccctactgcaaggtgggttcgacctcgttgagcatctcatggaacatggcattggcgcgatcatcgccggtggctgtgcccgtgacctgttcttcggagtggtccccaaagacatcgacatcatctgcgcgggcactgacccggagactgtttccagagcgctcgatgaaggtggtttcgtctacgagaagttcccgaagtaccacacaggttccgactcggaccgcctgcaaggtgtctggaagctcgaaggctcgaacatcgacgtgatcctttacgagaccgattgtgtctacgcggccatcggcaagttcgactacaacctcaaccagttcgccatcgtgggcatccctcggggcatcgacggggcaactattcgttacatgggcactgagcattggagcaagcttgtaaggctccgtgaggacgctcgtgggtcccgtgaggcgaagatggaagagaagtggctcgacctcgtgctgggccgtcctgccaatggcgagatgggcctgaagcatggcgagcgggagctacgcgatgtcgtccagtgaagacagagaagaaagtgtcttcattcagcacatcccctgcgagacctgcgggtcctcggacgccaactcactgttctccgatggtcaccaatactgtttcgcctgctctccagaggaagcctacaaggcccccgatgggaaggagcgaggcacaggtaaccgagagatcacccggcacgccgacacactgctaatgagcgagtgccaagggcgctaccaagacctgcctgcaaggttcctgcaagagtccatctgtcgcctctatggctactgggtaggcaaggcatggacaccgagcactggtaaggtggtgcctgtccaagtggcgaactactacgactctgcgggcaaccttcaatcccagaaggtccgcgatgcgtccaaggagttctgcaccaagggtgaccactcgaaggaagcattgtttggccgtcacctctggaatggtggtcgcaagatcatcgtcactgagggtgagatcgactgcctgaccgtggctcagttgcagggcggtaagtatccagtggtgtccatcgggcacggctcgaaggctgccaagaagacctgcgcggcgaactacgaatacttcgaccagttcgacgagatcatcctgatgtttgacatggatgagccgggccgcctcgcctctcaggaggccgctgaggttctccctccgggcaaggtgaaaatcgctgtgttgcccttcaaggaccctaacgaatgcgtccagaaaggcaatgcgaaggccgtcacggaccagatctggaacgcctcaccattcatcccggatggtgtggtatccgcgaagtccctgaaggcccgcatcaaggaaaagaaggtcatcccctcgatgcctctggaagcacctcatgaactccgtgagatgaccaaggatgtgcgggaaggtgaggtcattctggtcacctctggttccggctctggcaagtccaccttcgttcggcagaacgtctacaacctgttccacaacgagggcatcccctgcggtgttgcgatgctggaggaggccgtagaggaaaccgtacaggacatcgttgggcttcacatgggctcacgagtccgtcagaaccccgatgagaccacggaggagatgtttgacgcagcctttgacgagatctttgcgtctgaccggctgttcctctatgacgcctttgcggaggccgctgaggatcgcctgttagccaagctgggctacatggtggccgctgagggctgcaaggtgatcgtcctcgaccacatctcaatcgtggtgtctgccatggacggtgataacgatgagcgcaagaccatcgaccgtctgatgaccaagctgaagtccttcgccaagagcaagggcgtggctgtgttcgtgatctgtcacttgaagaaccctgacaagggcaagccacacgaggaagggcgtccggtaacggcgactgacctgcgaggctcgggcggacttcgccaactgagtgacacgatcatcgccgtggagcggaaccagcaaggggcaaacccgaacctgatcctgttccgcatcctgaagtgccgcttcaccggggagaccggaatagcgggttacatggaatacgacaagcgtactggccgactggtcgctaagcctcatggctggcgtcctgatgctgacgaaaccgacacgaccgaagccaactggcagggtcaagaatccgactattaaggagaactaccacatgaaaactttcaacttcgacatcgtaaccgtactgctggctctggctggtcgcatccaaactcgccgccatgaaaagctggtggcccgtgaggcttccctgaaggctgccattactgccgcgcaagatgctctgcaagcaactgttggtaagcgcgtagttgccgactgggacaagaacgatatcaccagcgtacatcgccggatcacgaaggttctaccaactcaaaagtaatcggattgttgaaatccaagagcctccgaaagggggctttttagtttctacaaaccaaccaaaccgtagaagggagggaataccaaatgactaattccgaagtacgcgcgcacctgcgcaaaggcgaactcgctgtgaaactgttggaatccatgggttactcgtgggctgatggtgaacgcgagcgccctgagtggcacgccccagcgccaaagcctgaggacgaactaacggcgtccatcaagaagctcatcaaggacgaacagaccaaggcgtatctcgctggtgaacgtcatggcctaatgaagtctgccatggagactggccctaactggcatctcgttaagggttacgttggcaaggacttcatgattcgcccagagaacatcccggcagatcacacactgtccaactatggtggcaaccacttccgtggcatccgcttcaaggccctgtcgattcaatacgagaaatcggcgcattacatcggctacacggtgtcgttcaacttcaacacccgtccatacacacctcaggtaatccggttgcctctgagcgccgttgccttccgttaaacaggagggcctatgctcatctcagatattgaaacgaatggacttcttgataacgtcacgaagttccattgcgcaaccattcaggactactttaccgggcaatacactcggtacagtgagtccaactttgcggactacattaaggccctcgaagaagaagcggcgaaacctgacggtctcattgtcgggcacaacttcatcaagtacgacatccctgtactcgataagctgaagcgcctgtacttcgggaagcgcctgaacattccccgcaagaaagtgttggacactctggtcctcgtccgcctgctccactccaacatccgtgaccgtgactctggccttcttcgctctgggattctccccggcaagatgtttggttctcacgctctcgaagcttggggttatcgactgggcgagatgaagggcgagtacaagaccgacttcatgcgccaactccaagacgagggcactccctatgtggatggcatggagtgggctgtctgtaaccaagcgatggaggattactgtgagcaagacgttcgcgtcacctcgaagctgttccgcaagctcatggatgacactcactatttcaacaatggcgagggcatcgaagcggttcaccttgagcacgctgctgcatggactctggcccaaatggagcgcaacgggtttccgttcgacttggacgccgccgagcgtctccatggtgagttagcggcccgccgacaggacatgttggtccagttgatccagaccttcgggtcatggtgggcagccaaagggggcacctctcagtttctccatccgggaactggtgagcctctggagaagtacccacgggtcaagtacccaaaggtcggtgacatcttcacgaaggccgggaagctggacaagcgggagaccgtcacaggtgccccgtacacgcccatcgagcagatcacgttcaaccccggcagccgagcgcacctcattaaggtcctcaaggatgctggctgggaacctactgagttcaccgacaacggtgccccagtggtggacgatgagaccctcgaaggtgtccgcgtagacgacccagagaaacagcggtgcgtcgagctggtccgtgagtacctcatgatccagaagcgcctcgggatgttggccgaaggtgataacgcttggctcaagatggtccgcgacgatggctcaatccacggcaacatcaaccccaacggggcggtgactggtcgtgcgactcacagctatccgaacatgggccaagtcccttccgcgagttccccttatgggcctcattgccgcgctctcttcggtgccatccatgtgcgtaagcgcaagggctgggaagcgtgggccaaggtccgccaagtgggtgtcgatgcgtcaggccttgagctgcgctgtctgggtcacttcggggcccgttacgacgaaggtgcgtatgcctctgaggttctggagggtgacgttcactgggcgaacgggttggctgctggtctggttcccgctgggaccattcgggacaaacacaacgaggaccacgaggcatggagagcgaatgcgaagacctttatctacgccttcttatacggtgcgggagacggaaagatcggctccatcatcggcaagggagcgaaggaagggaaggcactgaagaaagccttcttggacaacaccccagtcatcaagagcctcagggagggcctcgaagggtctctcgtcgctgagcagaagtggaaccaagtcaccaagcgcttcgacgtcaagtggaaacgccgctggatcaaaggcttggatggccgcaaggttcacgtccgctcgacccactcggcactcaatacgctccttcagtcagccggtgcgctggtctgcaagaagtgggttgtggccgtcgaaaggattctcatggaggaccatggcctgtatcacggctggttcaaagatgacgggtccgctggtgacttctgcttcatggcttgggttcacgacgaacttcagatagccgcaagaaccccagagatcgcagagctgatcgctcaggtttcccaacaagccatccgtgaggttggcgaatcattccaattccgctgcgtactggataccgacttcaaaatcggtgacacatggcgcgagtgccactaataggaggacctatgtccaagagttttaacgtgagcatcaccctgaacttccgcgcagtcttcaacgacgagatgctcaatgatcttcaggaagttctcaaggcagccgctgacactgtagcgaaccctactgatgctgctcccggtggagttgcagttgcgaaaaccatgctggcccttcacgaacagaaaggcgctgatggtctcctgacgttcctccttaaggacagcgcaaagcaagtccgtgagttggttatgaaggagtgcggtgggtctggcttcaaggacttcgccccggctctctgcgtggtaactccacgggtcaataaaggcaagcccgaagtgtgcggtctgcatcctgaggacaaagcctgtacggcgctgtgtaagcgattcacggtgacccaatgaacgagtacctaaaagttctctgggagatcaagaagcaagcccgtgcatatcaagccgacttcgtgcggtcccgcattgcgctggtcaacgaggcatcaagccgtgggcacatctcgtgcctctccactgctggaaagaacatggggttctggtctctgacgaccaagggccaacagttcctcgcagaacatggaggtgccgtgtgagcaaacttctgaaagtaggtttggccctcgatatggactacctgatcttctctgcgatgtctgcggctgaagaggaagtagattggggcggtgatgtctggacgcttaactgcgatcacaacaaagctcgacagattctgttcgggaccatcaagtccatcaaagcggatattgctgggcaactgaagcgcaagttcaagttgaccgaagaccgctatgagttcgttgacttgtgcatcatctcgggtgaggacaactggcgtaagaaagtcctctggtcctacaaggccaaccgcaagggcaagcgtaagcctgtcggatacccagcgttctgcgagggcatcatggatcacttcggtcctgagcggtcctttaagtgggacggagtggaaggcgatgatgtctgcgggatcttgatgaccaagcctgagttggccggttgcgaccgcatcatctccgtgagttgtgacaaggacttcaacacggtccccggttacttcttctggttaacccagatggaactcgtgaagaacgacgaagcaactgccgacaagttccacatgcttcagacaatgatgggcgatgtcactgacggctacggtgggattccggggatcggcaaggagaccgctaaggcgttccttgagtccccagagttcttctacgaggccacgaaagtgatgaagtccgggccacgcaagggtgaggaagttccttattggacctcgatgacactctctgaggccaaagatgggccgctgggtccgaccgctgaaaccctctgggactgcatggtctccctcgctgccaagcaaggcatgtccgaagaggacctcaaggttcaagctcaagttgctcgcatcctgcgcgcctctgacttcaacttcgagactcgcaagccaatcctctggcaaccagcgtgatgggctatctggccttcgctatctggtgcgtgggtatggcagcgatgctccgctaaaaaccctcactatggctacctataggggttctaactgattttctctcagttgggacccttcgttatttaaggagggctcatgctccagatcgttaaacaccacattcaaaaccccgacgatatccctgacatcccgttggcctctgccgagtacctctcagtccgtctcagtcaatcctatctgctcgccactggcgtgctggatgacctgcggaaggctgggtattcggaaggctacatcctcggtttccttgacggctgtaatgctgccactgagatcgttgagctgatgcaggaccgtcaaagacaggaggactaaggccatgtgtttcaaatccaaagtcaagactccgaagaccaaccctgatgcactgaaggcacccgagccggttctcatcgaggaacctaaaggcgtggacttcggcgcatccgaggacgatcaatccactgaatctggcgtggatggtctgacagtcgagaaggattcttcggccagcgacaagggtgatgggagcggttcggcagtcgccaaagataccggcttcacatccaccaaaaagacctctaccagttccgttaagcgggccgtgaagaaggtcaccaagtgataacgcagtggcgtacccaaggcgaccaagccgtattccgtgagcgcctcacagagatcattcagatgttccccgagatgaccatgcagcgctcccacgaggaagcctacgaggccatctgcgaggccactgaggatcttgaggcgtgggtcgagctggtcgttagggacgcctctgggaagcttgtagcgttcgctgtagccactgatgacgacgacagccatgtagggcccctcttaggtgtccagtggcggatggtcttccctgaggccccaacggggaccgcattgcggctccaaagagaactcgccggaatcgctcgggcgagtctgtacaaggtcatggcgtataccaagcgcttaggcgtaggccgctatgagatcaactatctgaaactgaaggaggaaccccatggggaagaaaattaagaaggtcgtcaagaaggtcacgaaggtcgtctcaaagtcaaccatcggtggcggcctgttgggtggtgatgacgacaagccaaaggtagtcgaacaagctgctgctccagtccaagccgctgctcctacgcctgtcgctgctgcaaccgttgaggcccccactgaggacaccagtggtgaagacgatggcgacaccgaggctgccaagaaggccgcccgtgcgaaaggtaaacgcggtctgcaagttgcccgctccgctggtactggcatcaacatttaaggaggtgacccatggcaactaccgcccgagagggcctcgctgaggaaggcgcaaaggccgtctatgaacggctgaagaacgaccgcgttccctacgagacccgagcggagaactgcgccaaggtcactatcccctccctgttccccaaagactccgacaacgcctctacggactatacaactccgtggcagggtatcggggcccgtggtctcaacaacctgtccgccaaggtgatgctcgctctgttcccgttgcaaacgtggatgaagctgaaggtgtccgaatggcaggcaaagcaactggtcgctgacccgtcgcaactggctgttgttgagcagggtctgggtatggttgagcgaatcctgatgtcctacatggaagccaacagctaccgcgtgacgctctttgagttgatccggcagttggctctatcgggctcggggttgctttacctcccgccgcctgacgcaagttcctcaagctacaacccgatgaagctctacacgttgcacaaccacgttgtccagcgagacgccttcgggaatgtcctgcaaatcgtgaccctcgacaaggtggcctatgcggctctcccagaggatgtccgtaacagcattgacacgcaaggccaagaggccaagcccgagcaggaaatcgaagtgtacacccacgtctatctcgacgatgagtccggtgagtacctgagctatcaggaagtcaatggcgcagaagtggatggcactgacggtcagtaccctgtggatgcctgcccatggatcgccgtaaggtggaccaagcgggacggcgagcactatggtcggagccacgttgaggagtatctgggtgacctcacgtcccttgagaacctctacgaggccatgattaagttctcgatgatcgcctcgaaggtgatcggtctggtgaaccctaacggggtcactcaggttcgccgcttggtcaaggcccagacgggtgacttcgtggcaggccgcaaggacgacattgagttcctgcaactggaaaagaccgctgacttcacagtggctaagtccgtggctgatgccattgaggggcgtctgagttacgtctttatgctgaacagtgcagtgcagcgacaaggtgaacgcgttacagccgaagagattcggtatgtggcgtctgaactggaggacacccttgggggcgtctattcgatcctctcgcaggaactccagttgcctatcgtccgcatcctgttgaaccagcttcaggcgacctcgcagatccctgacatgcccaaggaagccgttgagccgaccgtgagcactggcgtggaagcgctgggccgtggtcaggacctcgacaagctgaaccagttcctgtcctctatggcgaacgtggcgcagctacaaggtgatgcagacctcaacatgagcaacatcaagctcaggctcgccaatgcgattggtctggatacaagtgggctgttgctcaccgagtccgagaaggcccaagcgcagtcccgtgagatgctccaacagggcggtctcaatgctgctgctggtctgggtcaagggatggccgctcaggcgaccgcaagtcccgaagccatgagtgccgcaatggacactgttggtgttgagccgggtgcaatcggcgctcaagtttaaaaccctcactatggctacacacaagattaaggaaacctacgggcggactttgagtgtgtggccctcattttatacaggagactttcaatgactgatgtatacgccgagttcggtgtcaatggtgcagtaatgtcctcgaacaacattaccgaacacgagcagaatatgttggccctcccaacttccgtccgtgatggtgatgattccatcgagttctccgaggtcccagaagagggcgaagagtccaatctggaagaaggcgcagaagaacaagaagaaggctccgaagaaggcgaacaggatggtgtcaacgatgacgctgaatccgatgacttcgccccacttggcgagcctgacgctgaactggtcaacgcctctaaggagatcgatgagtacgcagaaggtttccagcaactgcgcgcccaagccattaaggcaggtctgacgcctgaacaggcagacgccattgaggccgactacgagaccaacgatggggccctctctgaggcttccctgaaggctctcgaagcggttggctacagccgtggtttcgtgcgttctttcattgcaggccaagaggccgtctctgagaagtacgttgcgaagatccaacaatacgccggtggtcctgagaagttccaacaggttcttgctcacctcactgcgaactccccagacgctgtagttgctctcgaagaagctatcagccgtcaggatctggcagccgttaagaccatcatcaatctgggtatgcagtcgcgctcgaagaagttcggcaaggccccagagcgtaccgtcaacaagcgcgcttcggctcccaaggcgacctctaagggtcctgagggttatgcctcccagcgcgagatggtcgctgcaatgtccgacccgcgttatcagaacgacccaagttatcgcaaagccgttgaggcccgcgtttacaagtccaactggtaatccaccagatttaaaaaccctcactatggctacatgaagttccaccaattcagtttggaggacttcgtgtgtcccaatgaatctaatagaaggagtctcatatatggcaaatgcaactggcggtcaacaaattggtgccaaccaaggcaaaggtcaaagcgcagccgacaagctggcaatgttccttaaggtgttcggtggtgaagtcctgactgcgttcgctcgccgttcggtcaccatggacaaacacatggtccgcaccatccagaacggcaagtctgcaagcttcccggtcatgggccgcaccaagggttactacttggcacccggcgagaacctcgatgacaagcgcaaggacatcaagcattccgagaaggtcatcaccatcgacggtctgctgacttctgacgtgctgatctacgacatcgaagacgccatgacccactacgacgttcgcgctgaatactcggctcaactgggtgaggctctggctatcgctgctgacggtgccgttctggctgagatggcgaagctgtgcaacctgccagccgcttccaacgagaacatcgctggtctgggtactgctgtcgttctgaacatcggcgctgctgctgacctgatcgacgttgaagcccgtggccgtgcgatcctgaagggcctgaccctcgctcgcggcaagatgaccaagaactacgtccctgctggtgatcgtcgtttctacacctcgccggacgactacagcgcgatcctgtccgctctgatgccgaacgctgccaactactcggcactgatcgacccagagaccggcaacatccgcaacgtcatgggcttcgaagtcatcgaagttcctcacttggtcgttggtggtgcaggtactgatgctgacggtgcaaaccagaagcacatcttcccactgaccgcgaccggcgatgacaaggttgctcagaacaacgttgttggcctgttcaatcaccgctccgctgtgggcactgtgaagctgaaggacatggcactggagcgcgctcgtcgtgctgagttccaagccgaccagatcattggcaagtacgccatgggtcacggtggcctgcgtcctgaagccgctggtgcgctggtcttcactccagccgtctaagtaacaccacaaaccccttagggcctctcacagggctttgaggggtttttcgtttaggagaaccccatgcgttcatacgaagcaacattagaaacagatgacgaacttgcggccattaacgacatgctcgcggccatcggtgagtcccctgtgagttcccttgagggtgacgccaacgcagacgtagcgaactgtcgccgcatcctcaatcaggtcaaccgtgagatccagtcgaagggctggacgttcaacattgaggaaggcgcaacgctctccccggacacctttagtggcctcatcgaatacatgagcgactacctgcgcatcaccacatcgggcggtacagcgttcatcaaccggggcggttacgtctacgaccggacgaccaagaccgacatcttcgccggggatatcacagtcgatctcatccgcctgaagacctacggcgagatgcctgagtgcttccgctcttacatcgtcgctaaggcgtctcgcaggtttcagatcaggttcttcggagccggggaacttgagggtgccctacaggagcaggagaaagaagcgtggcaggccattcaggaatacgagctggactacggcggtttcaacatgcttgacggcgactcgttcgttggcgggctcatctcacgataaggagggcctatgggactcgtttcgcaatccaccaagaacctcaagggaggtatctcgcagcaaccgaacatcctgcggttctccaaccaaggcgaggttcaaatcaatggctggtcgtcggagacccagggtctacagaagcgaccgccgagcacgttcctcaagcgtctccagaacgttgggtatctcggggccaagcctctggtccacctcgtcaaccgggacgccaaggagcaatactatctggccttcagtggctcaggtgtctacgtttgggacctcaaaggtaacaactacgcggtcaacggatacaacggctacgcgaactgtgcgaacccacggacggaccttcgggtcatcacagtggctgactacacgttcgttgtgaaccgctccaagaccgtccagatgaactcgacactgacggcttcgggttaccctgcgctgctccagagggccctcgtgaacgtacggggtggtcagtacggtcggaccctttcggtcctcatcaacgggaacaccttcgcatccgtgaagatgcccaacggttccgccgagaaggtcccttcgggtgagccctatgcgggcatgaaccaagtggacatgacagacgccacatggatcgctgagcaactcacagcacaactcacagcggcgctcgggccctctggttggaacttcacggcaggcactggctacatcctcatcaccgccccgaacgggaccaacataagctctatcgggacccgcgatggttacgctgacacgctgctgaatgccttcatctatcaggtgcagtcgtttaacaagctgccagctaacgcaccctctgggtacatcgttgagatcaccggggagagcgcccgctcaggggacaactactgggtcgtctatgacgcagtgggcaaggtctggaaggaaaccgccaagcccaagatgatctcagggttcaacggggcaaccatgccgcatgccctcgtgcgtcaggctgatggttccttctcgtggactgtcctaagttgggacggtcgggcctgtggtgacgacgatacgaaccctatgccgtccttcgtggactcaacgatcaatgacgtgttcttcttcaggaaccgcttgggtttcctctcgggcgagaacgtcatcatgtcgaggacttcacgttacttcaacttcttcccagcgtccgtagcgaccctgagtgatgacgacccgattgacgtagctatcagccataaccgcatctcgattctgaagtacgcggtcccgttctcggaacagcttttgctatggtccgatcaagcccagttcgttctgtcgtccaacggcatcctgtcgtccaagacgattgagctggacctgacaacagagtttgacgtgagcgatggagcaagaccctacggcattggccgaggtgtttacttcagtgctccacgggcatcctttacgtccctcaagcggtactacgcgattcaggatgtctctgacgtgaagtccgctgaggatgtctctgcgcacgttccgagctacttgccgaacaccatccacgctatccatgggtcaggcactgagaacttcgtgtcgatcctctcggacggtgagccgggcaatgtgtacatctataagttcctgtatctcgatgaggtcctacagcaacagtcgttctcacattggaactttggggaaaacaccaagatcctcgcagcggctgccatcgggtcctatatgttcctgctgatcgaacgacctgaggggatcatgttggaacggatggagttcacccagcacactatcgacttcgccattgagccttaccgggcctatatggacatgaagcgggaagtgatactcggcgcgtacaacatcgacaccaacttaaccgagttggatctcaccagtgtgtatggcggagtaccgggagcagacgcggtgttctacgctctggaccagaaaggtgtcgtcacagagttccaaggaccatggaccagttcatctaagttgtacttcacgggcaaccgtgcaggcgagcgtctggttatcggtaagcaatacaccttccaatatgagttctcgaagttcctcatcaagcagactgcggatgatggctcgacttccactgaggacattggtcggctgcaacttcgccgcgcatggctcaactatgagcaatcgggttcctttgagatcaacgtgagcaacggctcaactgagtacgtttacgttatgtcaggtggtcgccttggtcagggtattactctgggcgagctgtcgctgggcacaggtcaatacaagttcccggtaacaggtaacgcgctcaatcaacgagtgaccatcaccagcgatacaccgaatcccctcaacgtgatcgggtgcggctgggagggtaactacatccgccgatcttccggtatctaacagttgtcaagtgggggcctcaaaaaccctcactatggcaccctatgggggttttcatgattatcacacaagcaactaaacgagaccttgaggaagcctcagggaacctctcgaagaacgaccttgacgagttccattcccacacggctgggcgtgacccacgcgataccctgcccgcctgcctcgacgagaccactcgtgcgatcaaggtgggctctttggttttggctgtaggtgggtccaaggactgcctctggttcgtgacgaccactgttgtggatcgactgaccaaggcgcaacgcatgaggttctacaggctgctcaaagggcacttggaggacatcaaggatcatgtgccgaataacaaggccctaactaacttcgtctctgtcaacaacaaaccgcatatccgtctgctggagtctctcggtgccaccttctctgagggcatcaccatgtcccaggctggatttgcattccgtcaattctggctataggagaatcgctatgtgcgaaccagtaagtatcggtatggccgttgtggctgtagccggtgccgctatgggtgcctctgagaaggcaaaggctgaaggtgccgctgaagacgcccagcgccgaacggcccgcgagcaggtcaagcaaaccaacatggctaacgccaacctcaacctgtccgctcaggacaagcaagaggaagcccgtaagcaactcaccgagatcaacctacaggcgacccgtaaccgggggaccatccgcaccgccatcggtgaatcaggtctctcagggaactccatggcacgcatacagaacagcgtcgagaacgaatcgtcggctgcgcgcatggacgtggtggataactatcaccgcgactaccaatccatctttgcgaaccagatcgccaacgtcgagaacaccaagtcggccctcaagggtcaggctcaggtcatcaagaccagcggcctatcgaacgccttggggatcatctctgcgggtgccaatgggtacgcaatgggtagctcgatggcgaagtctggaggtggtgggtctcaatccaacggtacagcggcaggaggtactaagtaatggctaactcaatcgagcgtgcagtagacggcgctcagatgcaaaagagcggtcggctcaattcctcagtggggaccgtagggttccaagcgtccgctcaacgggcccctgtgggttctaacggattcgctgcggccatgaacgacttcgtaaaggctggcaccaatgcctatggggcctatcaggaagccagccagaaatccgctgaggctcgctctgacgagatcatccgcaagctgaagcccgaccagatccgtgaggccatctctgcgggcacccttcagtatcaggacgaccctgatgcaatgaacatgctgcgctacaagtcggggcgctctgctgcctatgacgtggacagtgagatccagaccaagatcaactcgggtgagttcgacaacaaggaccgcgcgtggctggctgaataccggcaacagcgcctaacggacgcagcgaagtcctatgcggaatcctcgggtttcgtggagaacgaccctgagtatcagcgtggtttcaacggtgacatcgtgcagcggaatgccgctctcttcgatgcccacgatacacgtcggtcgaagtggtatcagtcccaaacagcggtcaacgctcggggcgacttggggcctcttctggatgaccctgaggtgatgatgacgcccactggtggcggtcagatcgcagcctacttcaaccatggcatcgagacccgacagttccctactgaccagtccgtgatgaccgcgcttacccaactggtgacggacgctcagtccaagcccggtggtgccaatctgatccagaacctgcgcggccagtccattaatgtccttggaggtgcccgcaaggtcgaggacctcttcggtgcggatgtcttggacaacgccatcgtcaaggccaatgagaactcctacaagaaggactcagaccgcttcaggacgttctctctggggatcactcaggcgatcaaccaagacgacccggctatcgggatgacgatgatccagaagttccgcacggagaacgcatgggtgcaggtcggtgatgagatgacgcctcaaaagcagatgctcattaacgccgaacagacgttgctgactcgtgtccgtgaggactccgagagacgcgctgcgggcctcaagcaggctgcccagtcggacaaccggatggatgtcatggagcaggcgtatgccaagcgaatcgccggtgagaacgtcccagtgaaccccaaggatcaagccgtaacgcctgacactggggaattcaaggagtccgatggaccaacgttcgcggcccgcaccatggaccgtatcaagaactctggcctgtccgaggagaagcaggacgctatgcgcgcccagtacctcaacgctgactatgacggtgggccgttccagacctactacaagaccctcattacggacgcacagcgcgagtgggcaggtgccttgaggtcaggtcaggttggtgacatgccacgcctacaggaactccagagggcctatgtgacgaactccgctgtaatcgggaacgtcttcggggaacaagcagacttccttgagcaactgaaggacatggccgagagcggcatcgagcctcaggttctcgtggatgcccagaagtccaagaagggtctgtcaaccgaggaacagaagtttcgcaatgaggaatggatgaacctgatgaatgactcggccaacaaggacctgtcgtccatccccggaccccttcagcgcatggctcggaacatctatgacggctacaacgagcgcacaggtaacccgaccctcgccaaggaaaagctcaccgagtggctcaaccagaacacggtagcgttcaccgagggtgacgaagattccggctacatcgggagactcgacaagcgcagcctcatggcctccccagaggacgtgaactcgtggcaggccggtaaggaaattgttgatcgcaccattcagggcctccttgagactcccgcttgggcaggcgctggggcaaccgtaagcgtcaacgagaacaccggcgacatcaacatagcgtccccgaccgggcggcgcatcgtcctcacaaagcaatcgctccagttgatccacaaggcccaacaggaagcactcagaaaccaagaattccgcgaaggggttgaccgtgccaaggctacacaggcagcgggtcagacttttggtggcatcatgtaaggagaactccaatgagccgtaaagacgaatacgcaaaacttctggcaagtggcacgccatacgaccagatgattcgggaagctgctgatgcgcacggtgttgactacaactacctgcataagaagatcttcaacgagtccagcttcaaccccaacgccaagagccctacggggccacgtggtctgggtcagttcaccaaggcaactggacgggcctacgggctcgttacagacgaagacttcttcgaccctgccaagtccatcgacgcatctgcgcgcctcaccaaggaccttctggggacctacaagggcgactacctgaaagccgctctggcgtacaaccaaggcaatggtcggttggggtctccccagttggccgctctggatcgtggggacttctcgaagatctccgaggaaggcaagaactacatggcgaaccttctggatgtcgctggggattccccgagcaagaagtggttcgaccagccttccgccccaaagcaaaatggtgagttcgagaaatacacgcaaggactcaccaagcaacctcaggttgagcgtggcaactccaagggacctgaagggttcaatctgagcgagggtgcattgccccagacccagaagacctttcacgagatggactacgcccagaacgggcctcaggacgactcatggttccgcaacaccttcccagccgttgtggcatccattgataactcatggggaggcgccaagctgcgcgacctcttccgtgaggaggaacacgacccactggctgactacagtccaatccaagcccaatgggacgatgacgactacgagcagatccgccaagcgggcatccctccgaagatgtttcagttccttgtggagaggactcacggggtcaaagcggaactccccaacgccattgcggtagccaaggagaacatggcgaacgaagccatcatccgggattccggtatcggctcgcagttgctgggcggtgtcgctcaggctccgcttgatccaacctcgtacatcccagtaccgggcgctcaggctgccacgtttggtggccgtgtcctgcgtcagggtgcgttcacttcggcgctcgctgtgggctctgaggctctgcgtgagcagaccactgggatcgagggtcactacttggccgctgctgttggtggtgccgtgttggggagtggctttgccgctgtcctcgacaagcacatcgcccgtggcgtgagcaacgtaagggctcgcccagacatggacgatgaggcccttgaggcgatccttgcgcgtcacggtgagtcctctgagcccaacgcttcggtagatctggtggacggcatggagccaaccacaccgactgtgcgtgatgacgtgcaggacgatgactaccttgagaagatcctgggtctccacggtgaacgccacacccgccaagaaggactcaaggatctccctgatgacaccattgagggcatccttgcgcgtcatgcagagtcttcagaacccaacgagttctacagcgtcacagcgcgcctacaggcacgtgaagatgcgcgcctcgctggtggagaggacccaaccaagatgccatggaactccgatgacgttcccgacagtcacgatggaatcgactttgtggacgttccgggcgaaccgggcgctgtgcgtctgcgtgacggctcaatcatctctgcgtccaacccgatcaacccgaagaccctgcgcgcagtggctcaactggagcctgagcgttcggctgctgggttcaacctcggggccatcgctgagatcggctacacgctcaaccgtacagaagacgaagccatccgcaagataggtggtcaactgttccgctccacggtgcaaaccgagtcgggcaccaatggcaagtttggggcaaccgcttcggacatcattgagcgcatccgaggggaggaccatgtgacctacgggaagctgaacgagctgaccgaaaagaccctcaaggaggaccctcggtacgccacgcagccgggcatcttgtccaagcgtgagttggcttatcgccgggtcgtcgaagccattgaggaccagacgaaggcaaagcaggccaagttgtccccgcaagaacgtgagctgatggatgtgattaatggtcacttcacccgcaagcaggacatgctggagaaccctgcccagttcggtaactcggaagcggtgagcctgttggacaccacgcgccacgctgggtcctacgtccctcacatctatgatgacgcagccaaggctatgcacatccgtcgcttcggcggtgaggatggtttgcagcgcgccattcaggaatcatggttggcctcctatgccgctcgcccagtcgtcaaggctcgggttgataaagccatgaaggcagccattgagaaggagggcaaggtagcgacacccgaggccatcaaggcagccgtaacgcggtacgccaacgacaaggcttttggtatcagccacgaatccaagtttaaccgtagctccctgatagacgatggtctgaacaacctcgtgggtgcggagaacaacaatttccttgaagcccgtaacctgttcgactcggacgttactgtcccactgtcagacggttccagcttcgcggtgaacgatctccgtgtcttcgatgtgcctcgggtcatgtcttcttacgaccgtcgtatcaacggcgacgtgggcatcatgggtgcaactggcaagaacaccgatgcgctgaaacaggaggtcctcgccatccagacccgtatgggcaaccacaaggacgctacagcactggagagcgccgtaaagctgctcaccgggagagcccgtagagatcctgatggtgtctttgggacaatcgcaaggtccctcaacgatctcgctttcttctcgaagaacgcctacatggccgctcagaacttcactgagatcgccgggatggtcaccaatgggcacgtccgtatgctgatgcatggcgtaccattcctgcgggagatgaccacatggggctcgaagatcacccctgagaacctcaaggagatgcatgggatcgtctttggccgggagctggatgatgttatccgccctcgccgtcaggacatcgttgatcgcctgcgtcaggtttcgagtgggcctgtagctcagactgtagggaccctgaagttcgccacacaggaacttgccgctcggagcccattcacccggatgctcaccgagacgtccaactacatcatcgaggctggccgtcaaggggccctcatggacatggtgaacgctgcccacgggatgcccgccaaggtcatgaccaaggaacgcctcaaccaactgtcgatcaccgaggcccagtttggagacatcaagaacctcatccgtcaacacctcgtcaaggatggcgacagctataagatcaaggatgcgaacgccttccgggctgacccacgcaccatggacctctggagactgggcgataaggtggccgatgagaccatcctgcgtcctcacaagctgtcctctcaggacaccaaggcgctgggcgctggctggcatatggcgctccagttcaagaagttcgtcctgaggaccctcaatgcccgtctcgtgcgcagctactacaacgccacgaagaacggtcaggcactcgatgtggccctacaggctgtcatctccacgggcctcgcaacggggttctatgtggctcaacgctacgtgcaggctcagggtctcgctcaagaacgccgcaaggagttcctgaagcaggcaatgaccaaggagatgattggctgggccgctctgtccagagggaacatcatcggggcacctatcggcgtggcgaacttcttcgcggctcctctgggttacgacccggctgctgctgtgcgtacctcgattctcccgcgtggcccagagttcaccaagcgtgagcacccaacccggtacaacccacttcgctctgacggcattcaggctcccttgagccgagtccttgagcaggtgccctcaatgggcgtccttgggtcgttctatcaggtcggcgcgaacgctgatggtatctgggggagttctccaaggaactctcaggaacttggttacatgactggtttgtataacgggctgcgtggtttggtccctaacgacccgatctcgcagaaagcaatgtcggcaatcatgcagtcgcaaggcatggaataccgcactcgctaaaacccctcactatggctactgggctctcacttcgagggcccttttttattaaggagactctatggctaccacacccaaaacggtgcggacgtggactctgaatagttccctcagagactttacgatccccttcgagtatctcgctcgtaagttcatcgttgtgactctcatcggggcaactcggagagaacttgtcctgaacaccgattatcgtttcgtcaccgcaacgcagataactacgacccgcgcttggggcactgctgatggctttgatctcatcgagattcgccgggttacctccgcttcggagcgcctcgtggacttcgctgacggttccattttgcgggcctacgatctcaacatctccagcgtgcaatccctgcacatcgctgaggaagcccgtgacctgaccgctgacacaatcggcgtgaacaacgatggcaacctcgacgcccgtgcgcgccgcattgtgaacctcgcagatgccatcgaagatggtgatgctgtcaacctgcgccaacagaagcaatgggcaggctctgcgctcaatcaggcacaggcagccgcccagtctgccaatcaggcggaccagtaccgttcggcctctgtgaccgctgctggggcctctcaggacgctcgggacctctcactgcaataccggaatcaggcagagacctttaagaatcaggcaggccaatcccaacaggccgcgtccacgtccgagaataactccagaatctgggcctctcaggttgaggacacagtggtctacaacggcctctattcgtcctatcactacagccggaaggctgctgcgagtgctggggctgctgctggttctgctactgcggcgtctggttctgcgagcgctgctgctggttctgcgacgaccgctaagactgaggccgaccgggcaactaccgaggcgaataagctgggtaacgccaaccaattcatggggaccctgagatccgttgagggcgacccaaagcgaatcatctggaatgacggttatcaactctcgttcaacaccatgctcgctgatgacctctacggtcgttccgctgacgttgtgaacatccgggctgcaaccttcaacgtccgaggcgctatgtccgtctggggtactgtgtcgctgggccagacccttgaagttctcggtaaggtttccgctaagggcggtttggatgtcacaggggcactcaacgccaccgggcaggccaaggccatcgatgtcttcagtgtctccccatcagggagcaatgcaaccaacacccacttctggatgcgtaacttcgacggaagcgagcgggcattgctctacggcgactacaacaacaacctcaacatccgtgtggccggtaaaaccgagtcgatcatcattagaggctcgaatggtgccgttgagttccctaatgggcgcgagattcaaactcaaggtggtatttacaactctggccggtgcgttactacgcgcaatggcgtacctattagctctgccatgtacgacaattcccactttgttgctcgtactacagacaactccccgcctgcttataccttcctgcgggatgggtattatgcgcttgccctttggttgaatggtactgacctaaacatcatggccagtgacggtaataaccgggcgcttgtcaccaacgctaacttcaatagctggctcgcatcaaacgggtccgctggtgccatcggaacttatgcattctgccgtagcactgctggttcacataacgcacccggtaactctatgtctggtgccagcctttattactcagacgttgacaagaacaacggcggggcggttggtggtggtacttggagatccatgggatacggaaccagtacgggcgtcagtctgtacctgcgagttgcttaaaggcccttcggggcctctttatggaggacacaatgaacatcaatgtattagacgcaaaggagcctgtgcgagacgcagagggcttcattaccctgcaagttcttttcgagcacctcaaggatctgggatatgtcccgttctctgctcgtccagatgacgtagaggagcacggtcgggttcttttcgaggccgctgaggctggtgagtatggtgaagttgccgaattcgtccgtcctgatgtgaccatctacgacctacagtccgaattggacaagctgatgccggacatcatgttgggcttggcgacacccgaagagatctctctggctaagagtctgcgtgtgcagatcaaggcgatgtcgtaatggcaacttcccttgagatcgacttcacgaatggagtggttcgcgccgctcctatcgctgctggggctggtgccgaagtggcaagccaagtagcaggcatgaccctcagtgactggttctacgcaaccgtcattatctacacagtagtgcaaaccatcgtgctggtcttcaagacagtcatggatgagaagcgcaagaacaaaggagacccaccatgagtgataacgtgctggaaaagttgctggaggcaatcgacaccgacttgggtcgtcaacttctggctgacctgcgtgacgatgctcggcgtggtcctcaactgtacaacgccatcggtaagtaccttgagcgccacaagttcaccatcgctaagttgaagcctgacgagtcccttctgggagatctcgcattggctctcgatgaagtccccgagttaaccgacgaggaactttacggttccgctgctcgccactaaaggaggccccttatgttgaacctaaaagagttcgtcatctggggccttttggtttcggcaggtctcggcctgacgtacgccaagggtcacaaagatgcaacgaatgaactgaccattacccaccaagcggagatgctcgccgcgactcgacaactggaggtacaacgtgaaacaacccaaatcgccctcaacgcccaaagtgccgcttggcaaacgcatgttgcgaaaagtaaggaacttgctgatcggactattgctgatctgcgtagccgtggtatccggctgcaagtcaagctcaacgattccatcgtgtcctgcatcacaagtgacggtcgatcaatcactgatggtcgagccgaactacacccagacactgctggattccttatcgagcaagcccagcgagcagacgcccaagtaaaggcactgcaaggaactgtaagagcacttcaaggaggtaagcaatgaacgcaatgattgtcacgagtatgttgattctggcaagtaccccaaccggcccaataagcgacgaggaaaacttggctctgatgttcctttgtttcttcgtaatggcttgcacactgggccttctactgtgtctggcttatgacatctggaggcacaa

SEQ ID NO: 12 - DNA, 42526 bp, unidentified
  misc_feature 1..11: note = bacteriophages nucleic acid sequence
  source 1..42526: mol_type = genomic DNA
gtgtcgaaagtagcggcggcgtaagcgtcgcaaggctgcgcgaaatgacgaaacagcttcgttaccgcaaaggctgaaaaaagttgttcgcaggtattgacgaagcgtcgaaggcgtcgtactatagacctataccaacgaacacaaggaaccgccgaaatgaaaaacgcagaaatcgcagcaatggaagccaaaatgtcgaaggttgcaggcgcagccgttgaacttaccattcgcgccgaacgcgcttttacgttcagcttcgaaagcgtcaacgaagaagccgccgcaaagctggcaaagttcttcgaaggtcaagctaaagtcgaagttgaacacgacgaagaatgcggttccttcgtttacgtcgattgcaagtaatcaacagcgcgccgggcgcaacccggcatttttgaaggagttataacaatgtgcatcgtatgcgatattaaacaggccgtcgaagcttgcggcccgaacaaagaagaccgcgccaaaatccttggcttggttgaaaagctggccgaagccttgggcgatgttctggaagtcgcgcaggaagtacacgaagccaaccccgaatcgttccagcctgaacacgtcgaacgcttgcagaacgccgccgacttgctgaacgaccggggcgaactgcccgacgccctgttggccctgctgttggccgcccttgggcgcggcgtcaaggtcgaaacaatccgcgttgaactgcgcgaaggcgaaacgccagaacaggccgtagcgcgtgtaatggccgaacgcgaaggcggggccgcgacgaaacactaaccaaagcgccccggctgttgtatagtcggggcttctttctatcatggggaacgaaagaacatggcggacgaagtagaccaaacagccgaccgaatagaaaacgaaataagctttacggtcggcgaactttgccgaaaggccgcagcgatacccgcaggccgtccgggcgaatgtgatttttgcggcgaatacttcgcgcgcgttgtcgaagtgaccgacccgcgaacgggcgaagtcgtcgaaagctgcggtcgctgtcgtgaccgaaggggcatcgcatgacgcccgcaacccttgccaagtctggcaccgaacacgcgcaccaaacggcgctttttgcctatgctgccgtcgcatacttgcacggcttcgacgttgccgacgaatggtcgaagaccggcaagctaccgaagcgcgacccggacgcaccgccgaaggtgcccgcgcttgaatggttccacgccataccgaacggcggcagtcgcggcgacgacgacaagtcccgcaagatacgcggcgcgcagttgaaggccgaaggcgtgcggcagggcgtagccgatacgttcttgccttggcctgtttacgaaccgtgcccaagcgacccgcaaataatgatgatgaaatgggccggtctttatatcgaaatgaagaagccaaccgaacgcccgaagtcggaaaccgcaaagggcggcgtatcggacgaacaacgaagcttcggcgaatacgcaaagcgcgtcggctatggttgggccgtctgctatgattgggaacaagcggcgtcgtaccttcgttcctatatcgaatggggttcgtaatggggctttcgtgccttgcctgcgaacttacccgcgcccggttgaaagcggcggcgctggcccttgtgggctggccccttgaccgcatcgccgggcatttgtccgtttgctatggcgaacggtattacgtcgaaggcggcaagctgtatcgcgcgtcgaagttgccgccgtatcaaccgcacttgataaggggcgaacaatgaaaaagaccgacgaagaattgatagacgaagcccgcagcatcgcgcgttcgaaacgctgtttcgtcgtaacgaagccgggttattggctgctgtaccgcgaatgcacgccgcgtaacgtatgcgtcggcaaacggtcgtcggcttcggcgttgctgcaacttgcgaaaaaggcttgacgtagcttcgaagctgtcgtacacttcttcgtaagttgaacgaaccaaggagtaacgaccatgccagcttataacgtaacaaccgaattcgaaatgcaagacgggcgcgttctgtcatgcgaatacgtcttgtcggttacgcccggtcgctattccggcccttgggaagattgctacccggacgaatccgacgcaggcgaaccgacgtactttatcgacggcgaagaagtcgattacaaagaacttccaaaaggattggacgcaatcgccgacaagctttacgaagctggcgacggcgaatacaattacaaggaagaacgcgacgaaccggattacgaaccggattacgattacgattattaacgaaggagtaacgaaaatgtcttggcttatcggttggggcgtactttccgtcggcgtcgttgtcggcttcttgcttgcggccttgctgcgggccaatgggcgcgacgtgccggttccttcggctaccgttaccgccctgtcgccgcaggaacgcgcccgcatgggctacgcgctggcaagggctggcgacttgctggatagcggcgaccttgaatacgtgtcgggcggctttatggtgcaagacgtaggacacggcgtcgtaattatcaaaggcgatttgtcgttgcgggttgccgaagatgaataaggacgaagcgcgcgaaatgttcgaagccgtcaaggccaaccgggcgaagattgacggttgcgcccgccatcgtttcgaaataggcgacccgccgtacacgttcgggcaaaagttcacttgttcgaactgcggcggaacaatggacgccgtacaggcgttccgatactgtcaaggcttcaaggccgcaggcggcaacccgaacgaagttataccgggttacgaataacgcttgacaagcggcgaaggttcaacgaaacttagcacgtacccgacaaaggagttacgaaaatgaatttcgacccgttgtttcttaccatcggactttcggcgcttgcttgcgcttgttacttgaagttcggccaaatcaaagcgaagcgcgaacaagaccgccgcattcgcgaagctatcgaacgcgcgcaggttgccaaggcacgcggcgaaattcgcggcaagaagcttgccaacgaacgcgaatggggcttggccgaagattacaaccccggcaagatatggcgataatctacgcaccgcgcgaagccctgtccaaatgggacgcgcgatttattgaacttgccgaacacgtcgccggatggtcgaaagggccgcgtaagcgcatcggcgcggctatcgtgcgcccgaatcggtctattgcgtcgcttgggtacaacggcccgccgcgcggcttcgacgacgccgtttttctgaacatgacgcgcgacgaacaacacgcggtcgtaattcatgccgaagacaacgcaattcgacaggctgcgccgggcgaagatttgtccgcgtgtacgctgtacgtttcgccgctgtttccgtgcgccatttgtgccgaccgcatcgttcgggccggtatccgtcgcgttgtcgcttattgtgggcatatatcgccagactggcgcgcgtctgccgacgaagccgaacgcatctttaaccaagcgggcgtcgaatgcctgtttacaatggattaacgaacatgaaaccgctagaccattcgcaaatcgaaggcttgttgttctatcaagacccgacgacgcaaaactatatcggcgcaccgaaggccgacccgttgaaccctgccggaagcttcgtcgcattcgggccgcgtgttacggttgacccggcgttgtataacttgcttgccgccgcgcctgtaatgtaccaatcgctttcgaagcaatacgaatatttgcaagcacaaattgaagtaatcgaacgcttgccaagggtcggcgaacttgataagctgttgtcgtcgttaatcgaagcgcaaaacgcttgcctaatggcccaacgtatcgcgcaagtcggttacgaaaatgtcgcaaattcacttgacaaaggttcgaagcggtcgtaagcttgaaccatcgaaacgaacaaaggtgcccacaatgaaacgcaatcttcttgttatcgctggaatcgtcgccttcgtcgcgttgcttggtatggccgggcaaatggactttgaagacgaagcccgcgcgcacctgttgtattgtgacaacgtagcgaacggcgtttggccggattacgacaaaatttacgattctgaatgcacgcccgaacgcatcgcagaaattgaagaaattttgcgttgaccgcttgacacaacgaacggtcggcgtaaaatcaacccgtcgcaacaacgcgacataaccttaacgttaaggagttacacaaaatggctaccaagaaatcgaccgcgaagaagaacaccgccgccccggttatcggccttgccgaaattgttgcagccgggccgaatggtctgtatacttcgcctgccgtacatggcccgcttgtcgaagccggtatggtagaaatcaacccggcaatgaccaacgaagcgggcgaaatcgcaacccgcgcaacccaaaaaggaatcgacgaaatgaatcagaacaccgaaaccggcaccgccgcagcttccgccccggttgctacttccttcgccatcgaagataacgtacccatgccgaccggcagcggtcgcggtcgcggcggcaacgtttacccgttcgacgcgctggaagtcggccaaagcttcttcgttccgaacagcgaagaaaagccgaacgccgcgaagtcgcttgcttcgaccgtttccagcgcaaccgcccgtttcgccgtgccttccgaagacggcgcgaccaaggttaacaagaagggcgaaaccgtgcccgtcatggtcgaaacccgcaagttcgttgttcgttcggtcgaaggcggcgcgcgcgtctggcgcaccaagtaagcaacggcgcgggctacggcccgccctacgcctacgcttcaacggaaaccccggccattgtgtcggggttttcttttgcctttcttgtcaatttgtgataatccgtgttaatcttcggccaaatgcactttggggccggggcttgtgaatgaacgaacaacaattttttaacgtagccgtcgcaattatcggcgcgttgggcggttggtggatgcgcgttatgtggcagtcacttaaagaacttcaagcgcaagattcgaagttggccgataaggtcggcaatatcgaagttcttgtagccgggcactacgtaaagcgcgacgatatgaaccgcgatattgccgcaatattcgcaaagcttgaccgcatcgaagacaagatagacaaaaaggccgacaaatgaagaagcccgaacttatcgaagattggcgcgaatgctggcgcttttggtcggttcgactggccgcagtcggcaccgcaattactggccttcttgttgcgtttcccgacgcagctttggccgcttgggcaatccttccgcacgaattgaagtcgtcgattccgccgcaatatatgccgcttatcggcgttgttgttttcgcgctttccatcgttgcccgccttgtcaagcaaaagaacttgaacaaggggccgaaggatgaataacgaacttccttgggtagccgaagcccgaaagtatatcggccttcgcgaagacacttcgaagacttcacataacccgaagcttcttgccatgcttgaccgcatgggcgaattttccaacgaatcccgcgcttggtggcgcgacgacgaaacgccttggtgcggactgttcgtcggctattgcttgggcgtagccgggcgctacgtcgtccgcgaatggtacagggcgcgggcatgggaagccccgcagcttacgaagcttgaccgacccgcatacggcgcgcttgtgaccttcacgcgaagcggcggcggccacgtcggttttattgtgggcaaggatgcgcgcggaaatcttatggttcttggcggtaatcagtcgaacgccgtaagtatcgcaccgttcgcagtatcccgcgtaaccggctatttctggccgtcgttctggcgaaacaagaccgcagttaaaagcgttccgtttgaagaacgttattcgctgccgctgttgaagtcgaacggcgaactttcgacgaatgaagcgtaaaaggggcatcgtatgttttccgtaatttgggccaagtttggcaaatggcttgccgcaatcggcgcgggtcttgtcatgctggcaagtatcttttatgccggtcgcaagtccggcgcaaccaaggccgaagccaacgcagcaaacgaacgggcaaacgaccgcgaagcaatcgcagttcgccaagttaacgaagcccgcgaagcttccgaacaacaggtaaaggcggtacaaaatgcgaaagaagttgcttccgataattctacttttgacgacgacgaagttactaggcggctgcgcgacgaatggtcgcgcgactgaaccgcaaagcatcgccgacgcagtacaaacgaagcccgttgtaatcgacacggcttgtaaatgggttgcgcccatttggatttcgaaggccgacggcttgaccgctggcacggcccggcaaattctgaaccataacgaagccgtcgaacgcaattgcgggccgcagtcgccgcctaaatctgcggacaagccttaacagaacgcggggcttgcggtatagtgaagccaacgacgtataaactaggccgacactatgtccgacgaactgaaagaaagcgaagaaaaggccgcatacgcggcccttcttttgaaagaacgcgacccgtttaaggctgcgctttcgctgtttccgaacaacacgaatcgcgcgctatgggttgcgaaccattggccgaacgacgccgaagttaaggccgaacaaaagcgccttaccgacgaaggcggcgatatggcatttcttccgggcaaaggcgaccttgcccgcgacatttggcagcgtatgcaaggtacgacgcttccgaacggcgtaaccattccgccgacgcccgaagaatacgcgaagcttgccaagctttacgccgacgttcgcgggttcatcgaaaaaccgcaaacgaacgttaacgtaacgacgaacgtaaaccgcgtcgtcgaaatgcccgtattcgctaacgaaagcgaatgggaagcggaagccgcacggcaacagcgcgaattgttagaaaatgcacgcactcgccattgatacgaacggggcgaaacctgttccgtatgaagtcgtatttaagccccttccggggtcgcagactatcgccctttgttcgatggcagcgcatacgctgtacgaaggcgcacgcggccccggtaagacgcttacgcagcttatgcgcttttatcgtaacgtcggcaaaggctacggcaagttctggcgcggcgttatcttcgatttggaatttgaccatttgggcggccttgttgccgaatcgaaaaaatggttcggcgataacggaaagctaaaagacggcggcaagttttacgaatcaacgtcggcttataaatgggtttggccgactggcgaagaactgttgtttcggcacgttaagaagctgtcggattacgaaggcttccacggtcacgaatacccgtttatcggttggaacgaacttacgaagcatccaagcggcgacctttacgacaagtttatgtcggtcaaccgctgtacgttcgacccgataaaagacacgccgaaagacccgaaaaccgggcgctatttgacgccgaacggcgaaccgctgccgcctgtaaagtgcgaagtattcagcacgacgaacccaagcggccccggtcacaattgggtaaaacgtcgctttatcacgattgccccgcgcggcaccgtagttcgtcgcgaaattcagatttacaacccggcgaccgaaaaagaagaaacgcacgtaattagccaaatcgctatcttcggttcgtataaggaaaacccataccttccggcttcgtatatcgccgaactggaaagtatcaaagaaccgaacttgcggaaggcttggctttacggcgattgggacgttaccgcaggcggcgcaatcgacgacctttggcaatcgcatatacacgttgtaccgcgcttcgtcattccgccaagctggcgaatcgacagaacatacgacgacgggtcttcgcatccgtttagtgtgggttggtgggcggaagcggacggcaccgaagcgaccatagttctttcggatggcaccgaatttacgttttgcccgcaaccgggttcgcttattcagttgttcgaatggtacggatgcgcgaaagacgaaaagggcgaatatataccgaataaaggtttgaagctttcggcgtcgaatattgcacaaggcataatcgaccgcgaaatttcgctaatggcgaacggctggatttattcgcagccttggcccggccctgccgacaaccgcattcgccaagtaatcgacagcgaactagacacgaccgaaaagcttatgtcgaagaagggcgttcgttggacggaatcggacaagtcgccgggttcgcgcgtaatcgggttgcagcttttccgcgaccgattagaagcgtctgttaatcgcgaagggccgggtatatactttatgtcgaattgcgttgcaagtattgatttgctgcccacactgccgcgcgacgaaaagaagattgacgacgtagacacaaccgccgaagaccattgttacgatatggtgcgttatcgcgtattgaaaggcgcgaacaaagcggcagcgaaattcaaacttgttatgccaacttaaaggaacccaaatcatgccgaacgtttcatttattcgccccgaacttggtaagctgctgccgctgtattacctgattcgcgacgcaatcgcgggcgaaccaacggtaaaaggcgcgcggacgacttatcttccgatgccgaacgccgaagaccaatcgaaagaaaataaggcgcgttacgaagcgtacttgaagcgggctgttttctataacgtagcccgtcgaaccttgttcggcttggtcggtcaagtgttcatgcgcgacccggttgtaaaggtgcccgcgctgttgaacccgcttgtcgcaaacgcgacgggttcgggtatcaaccttacgcagcttgcgaaaaaggccgtatcgctgaaccttgcgtattcccgcgccgggctgttggtcgattacccgacgaccgaagccgaaggcggcgcgtcgattgccgaccttgaagccgggcgcattcgtccgaccctgtacgtatattcgccgactgaaattatcaattggcgaacgaccgaccggggcgcggaagaagttttatcgttggtcgtactgttcgaaacttggtgcgctgccgatgatggctttgaaatgaaaacgtcggggcaattccgcgttttgcgtttggacgaagaaggttattacgtccatgaaatttggcgcgaaccgcagccgaccaaagccgacgggtcgaagattccgaagggcaattatcagcaatacacggtttacaagccaacggacgcaaacggcaatcgtcttaccgaaattccgtttatgtttatcggttcggaaaacaacgattcgaacccggacaacccgaacttttacgaccttgcgtcgctgaatatggcgcattatcgcaattcggcggattacgaagaaagttgttatatcgtcggacagccgacgccggttcttattggacttaccgaagaatgggttacgaacgttcttaaaggttcggttaacttcggttcgcgcggcggtattccgcttcctgccggggccgacgcgaagttgcttcaagcatccgaaaacaccatgcttaaagaagcaatggataccaaagaacgccaaatggtcgcacttggcgcaaagcttgtcgaacaaaaggaagtacagcgcacggcaaccgaagccgaattggaagccgcttcggaaggttcgacgctttccagcgcaaccaagaacgtttcggcggccttcgaatgggcgttgaaatgggcggcccgttgggtcggtcaagccgacagcggcgttaagttcgaactgaatacagatttcgacattgcccgcatgacgccggacgaacgccgttcgcttgttgaagaatggcagaaaggcgcaattaccttcgaagaaatgcgaaccggcttgcgtaaagctggcgtcgcaaccgaagacgacagcaaggcgaaagaaaaaatcgccaaggataccgccgaagcaatggcccttgcgaccccggccaacgtgccgggcgatggcagcggcggcgataatgtgggcaacagtgaataaggggcgcaatcatggcactatcggacaataagcgactgtacgatattgcgacgcgccttgctgtttacgtcgaagacgtgaaagtttggcagtcccgacaattcgggttcgtacttcgcgaagtaaacttggaactaacgcgccttcttggtcgtgttcgttataagacccttgacggtctttcgaaggcgcagttaaacaagcttgtttcggaattacgggaatcgcaatcgaagatttacagcgcatacacgcaaacgctacttgaacagctaaaggaattcatgcgggccgacttggaagtaaaccggcgcgcatgggttacgggttatatcgaacttgacggcgaagaaagcgacggcattatttcggacgaagaagcaatacagtttcttttagaagtacccaacgccgattcgaaccctttgttcggtttggccgctgttacaggaagcgacgaacgcatttggtcgcaagttacgaatacgccaattccggcaaatggtctgtacttgctgccgtttatcaagacgtttacgaattcggcacaagctggcgtcgaaagcatgattcgcaaagcttgggcgaaccgttggacggttgaagaaaccttaacggcgcttgtcggcgatggaaccgcagcgcagggcacgccgtcgcagttgcaccgggtcaacgcgcaagccgcgtcggtaatccatacggcaaccgcgcacgttgcggcggtcgttgcggctggcgttatgtctgcggttttcggtcgttacgtttggtattcggtaatcgacggaaaaacaacggacatttgcataagtcgaaatcgccgaatttatcgcttcggcgaagggccgttgccgcccgcgcatatccgttgccggtcgcacgttgccccggcaaataccgctagtgacttggccgaagaaacgttttatacttgggttgcccgtcaacctgcccaagtgcaagacgacatattaggcgacgaaggcggcgaagctttgcgcgatggtcgcttaaaggcgaaggatattccgaagtatgatgcggacaggccgctaacttacgaagaattccgacgcaagattaaagaaattctttcccgctgattcggtgaatcggcataaccgcaaggagtccttgaaatggcactgaaaaagaaacttaccaaagaagaacacgcgaagctttcggacgcactgaaagccgaatatatcgaagacggcgacggcttccgccttgacgttgacggcgacgaagatacgggcgctttgaagcgcgccaaagaccgcgaagcgcagttgcgcaaagacgccgaaaaggaagcgaaggaacttcgcgaacggctggaatccatcgaaggcgacgacgcgcgcaagaagggcgacattgcgacgcttgaaaagtcttggcaatcgaagcttgaaaaacagcgcgaagaatacgaagccaaggtttccaagcttaccgcgcatacgacgaaaacgcttgtcgataacgtcgcgtcgcagcttgcccacaagatttcgaacgccccggcaatcatcatgccgcatatcaagtcgcggcttatcgcagacttcgaaggcgacacgccggttacgcgggttctggacaaggacggcaagccgtcggcccttactatcgacgaactggcaaacgaattcgttgcaaacaaggatttttctgctattatcacggctagtaaggcgtccggcggtgccggtaagccttcgcagaacggcggcggtgccccgaaatttaacggtcaatccgacaaacccgccgacctttcgaagatgaatcccgcagaacttgcggcgcatcttaaagaagcgaaggcaaacgaaactaaggacgcttaatcatggcactttccgaccttgctgtttactccgaatacgcttattcggctttctccgaaaccctgcgccaacaggttgatttgttcaacgctgcgacgggcggggctatcatgctgcaatccgcagcgcaccaaggcgacttttccgacgttgcctttttcgccaaggtaacgggcggccttgttcgccgtcgtaacgcctacggttccggcaccgtcgccgaaaaggtcttgaaacaccttgtcgatacgtcggttaaggtcgcagccggtacgccgcctgttcgccttgaccccggccaattccgttggattcagcagaacccggaagtcgcaggcgcggcaatggggcagcaactcgccgtcgatacgatggcggatatgctgaacgttggtcttggttcggtctattcggcgctttcgcaggttgcggcggttgtttacgacgcgaccggcaatactgcgccggacgacggcccgacttggaacaaccttaacaacggccaagccaagttcggcgaccaatcttcgcagattgccgcatggattatgcacagtacgcccatgcacaagctgtacggcaacaacctgtcgaactccgaacgcctgtttacttacggcaccgtgaacgttgttcgcgacccgttcggcaagcttcttgttatgaccgattcgccaaacctgttcgaagccggtacgccgaacgtttatcgcatccttggccttgtgccgggcgcggttatgattggtcaaaacaacgacttcgacgcgaacgaagaaaccaagaacggcgacgaaaacattattcggacttaccaagccgaatggtcgtacaacgtcggcgttaagggcttcgcttgggacaaggcgaacggcggcaagtcgccgaccgacgcggcgttgttcacttcgaccaattgggacaagtacgccacttccgaaaaggatttggcgggcgttgtcgtcgaagttcactaaccgacggcagacggacggggcttcggccccgttcttctagtccttcacaaattcaaaggagtttcgaagatgaaaccggcaaaaattctgttcttcgttgacggcaacgcgccgaccccggaagacttcgcagccgccgccgaactgaacgcgcaagttatgttcaggaacgcccgcgctgttccgtccgaaccgcattcgctggaaatctgcgacggcgtagcgggcaaggttccgaagctgtacgccgatgcttacccggaagcgggcgaagcaatcaagaagaaggccgccgaactgaaagcccttacttcgaaggtcggcgacgccccggcaccgaaggccagcggcaaggccgccgacaagcccgcagccgctacgcagggccagaccccggcgcagggccagaaagccccggcagcggccccgcagggcggcagcgccccggcttggaaccccaacccggcgcagtaacgaacggacggcctgtcgcttattgtgggcaggccgtttcaacaacgaactaaggagtcttcgcaatggcaacgaaaaaggttgtttatttcacggcaggcattaacgcaacggctggcgaacttgccgacattgcgaagctgaacgcagccgccgaaccgcaatacgaagttttggtagccaacggcgcagcaaatgccgaatacggcgaaaccgaccgaatcattccgtcggattacgtcgcgggtactgcgccttcggcttattccgcagttgacgttatcgaccccgacgcaatcccgaatcaggcgcttacggcaacgcaagcaatcgttaacgacgccgaagctttaaccgttccggttactggcacttacacgacgaccgcaaccgttagcgttgcgaacggcgttgtaaccggcatcgttctttcgtaaggacgttgacgcatggcaattacaatcgttgttgaagacggaagcggcgtaacaaacgcgaacagttacgtaagcgtcgcagacgcgcgcatttacgcttcgaatcgcggcgtcgaacttccgttggacgacgacgaattggcggccatgctgattcgttcgacggattatttagaagcgcaggcttgccggttccaaggcaagccaacttcgacgacgcaggctttgcaatggccgcgaactggcgtctttcttaacgaagacgaagtaccgtcgaacgttattccgaagtcgcttattgccgcacaagttcagcttgcgatggcgattaacgcaggcttcgaccttcaaccgaacgtttcgccgcaagactacgttacgcgcgaaaaggtcgggccgattgaaacggaatacgccgacccgctgtcggttggcatcatgcccacatttaccgcagcgaacgcgcttcttgcgccgctgtttggcgaatgcgcttcgaacaagtttgcgcttcgaacaataagggtttgacgaatggcacaattcgaccgcgcaattaagacggcccaacggcttatcgcgaagaacggcgaaaaggtcaaatggcgcgttatcgaagacgctacgccaacagacccgaacaagccttgggaacccggcccggctttgcccgaagacaaagacgttaccatttgctttttgccagttgaccggcagacgcaagaaaccttcaacttcattaaaggcaccgaagttccgaagggttccgtaatggggcttatgggcaatgttccgtttgccccgaatttgaaagacgttgtaattcgtaacggggtcgaacttcgcttggcttatatcgacgtactttcgccgaacgggcaaaaggtactttatacgatggtatttcaagcatgattgaattcgaccaagttaacgacgaagtaaacgcgctttttcttgcaacttggaacgcaggaagcgcggcaattgcgggttatgttcccgaaattcgttggcagggcgtgcaatatcgcgacttgccggacggttcgaagttttgggttcgactgtcgaagcaaaccgtttttgaagaacaagcgaccctttcaacctgcgaaggagtaccggggcaacgaaaatacacggcgtcgggtcttgtcttcgtacaaatcttttgcccgaaatcgaatacgcaagcgttcgaacttgggcagaaattggcgaaactttcccgcaatgcttttcgcgggaaatcgacgccgggtaaggtttggtttcgcaatacgcgaattaacgaacttccgcccgaagaactttacgaacggtttaacgtcgttaccgaatttgaatacgacgaaataggttaaggagttcttaacatggtatgcgaaattgccaaaatcgacagcaacattaccggacttgccttcgccgaagaagaatgcttgaagcaacttccgacgacgcccgtttggtacggactggaacccaacagctattcggacttcggcggcgaactttcgaccgttgcccgcgcgcctatcgacccgtcgcgccagaacaagaaaggcacgattaccgaccttgacgcatcgggcggcttcaacgccgactttacgaagacaaaccttgcgcgaattctgcaaggcttcttcttcgcagacgcgcgcgaacttccttcgacgcagccgcttaacggcgcatcggtcgcgcttaccggcgttaccgcaatcgacagcacttacgccgcagcttccgggcttggcgtgtttggtgccgatatgctggtatatgcgaccggctttgccaacgcggcgaacaacggccttaaaaccgtcgtttcgactaccgctgcgggcgtcgttgttgctgaaaccttgattgacgaaaccccgcccgcaggcgcgaagctggaatgcgtcggtcgccagcttgccgccgcagacgcgaacattgccgtaactggcaacgtcgtttcgcttatcgttaccgctggcgactttacgaccatgcccgaactgttcgccggtcgttgggtcttcgtcggcggcgatgcgacggcaaaccgcttcgctaataatgtgggctatgcccgcattaagtcggttgcagcgaaggcgcttgttttcgacgacgtaacttggcaggccgtcaacgaaaccggaaccggcaagtcgattcgtcttttcgtcggaactgttatcaagaacgaaaagaccccggcacttatcaagcgtcgttcgtatcaaatcgaacgcaccttgggcgaaggtttgaacggtacgcagtgcgaatatctggaaggcgcagtaccgaacgaatttacgttgaacattccgcaggccgacaagctgaacgccgacctttcgtttgttgcgtgcgataacacttatcgcagcggcgaccccggcgacgaacagaaaaccggaacccgcgtgcctgcgcccggcgaagatgcttacaacacttcttcggacgtttaccgaatcaagatggccgttcacgacgccgcgtcgtcgaaccccgccgccctgttcggctacgtttccgaagcgaacgtttcgattaacaacaacgttacgccgaacaaggcggtcggcgtgttgggcgcgttcgatacttcggcgggtaacttcgaagtcggcggttcgattaccgcttactttacgaccgtcgcagcggttaaggctgttcgcgcgaacgccgacgttggtttgtcggtaatcagtgcggccaagaacgccggtttcgtgttcgatattccgttgcttggtttgggcggcggtcgtctgaacgtcgaaaaagacgcgccgattaccgttccgctggaacccgcaggcgcagaaaacgcgaacggctatacgatgctgtacgaagtgttttcttatctgccgaatctggcaatgccggactaattgcggtaaactcaaagggccgggtaataccggccctttcttcattcaatcggagtaaatcaaatgtctggactgtttaagcaattcaaaacgaattcgaccaaggaagtcgaaggcgtcgaaatcgaatttcccgaagcgcagaacgacgacggcagcgttccgactttcgttatttcccgcatgggcaaatcgaacaaggcgtattcaaaggcgcttgacgcggcgacccgtccttatcgccgtcaagtcgaacttggcacgctgaaaaacgaagtcgccgaatcgctgtttatgggcgtgttcgtcgataccgtgttgcgcggctggaagaacgttcagggcgaagacggcaaggaaattgcgtattcgaaagacgccgcaatttcgcttctttccgaactgccggacgtttacgaacgtttgcaggaagaagccaagttggcttcgaacttccgcgacaacgctttggaagccgaagcaaaaaactaaccgaagttttggcgcacctgttggaacttggcccacacgaacaggcgatagcaaagcaagcgatgcgcgcggggcaaccgttacccgaacgcatcgcgaacgcgccagaacttgaagtaggcttgcagttgtatttgcaagccttcttcgacctagatagcgaacggtcgcacggcaacggtttaacgccgataccttggacaagtattgcggcttacgcaagggctttcgagtttgacgaagaacaaaccgaagacttgttttattttatgcgaaagcttgattcggaacacttgaagaaactagcggacaaacagaaagcggcggcatcgaatggcaaaaagcctgctagacctagccgataggctggaaaagaaagcgaaggcaatagacgaagcggcgtcacaaaacgccgtcgataccgctttggctattgtgggcgacttggcttacaaaacgcccgtagatacttcgcaagctttgtcgaactggattgtaacgctagaaagtccgtcgggtcaacaaatcaagccgcattttccgggttcgcagggttcaacgcaacgcgcttcggcggctgaaacgttgaattctgcgaagcttgttttacgaaacaagaagcccggccaagcgatatttattacgaacaaccttccgtatatccgcaggctgaacgacggttattcggcacaagccccggcggggttcgtcgaacgcgccgttttaattggtcgcaaaatgcgtaagaagttcaagattaaggattagaagaaatggccgacgaaaacatagaaattaaggttcaagacaaagtttcgccgtccatttcgacgaagcttcgcacaatcgccagcgaagcccgcaacgccgacgccgcagttaagaaccttcaaacgcagctttcggcaatcaatgtcggcggcttgtcgcagcttatcaacgcatcggccagcgcaacgcgccagcttcaacaaggcgcgcttgccgcgcaacggctggcaaccgaacagcagcgcaccgcaacagccgcagcgcaggccgccgcagcccaacagcgcgtcgcgacggctgcgacccaaggggcaaccgcgcaagccaaccttgccagcgccacgcagcgcacgcagacggcccaacagcagacggcgacagcagcgcagcgcctagcgacagaacagcagcggacagccgttcagacggccaacgcggcggcagcgaacgaccgggccgcccttgccgccctgcggctgcaacaggcgcaagaccgggccgccaattcgacccgcaacgcgacttcggcccttggcggatacattcgaaccgctgccggaattcttggcgtaacgatttcggcgaacgcaattcttgcaagcgccgacgcttatacgaccttgcaaaacaagttgcagaacgtaacgaagacgcaagaacaagtaaacacgcttacgaacgaacttttcgaactgtcgaaccgcacgcggtcgggcgttgaagaaacggcgacggcgtttgcgcgttttgaccgcgcattggcgtttatgggcaagtcgcaagaagattcgttgcgcttgaccgaaaccattaacaaagcccttatcgtttccggcgcaacagcgcaagaagcgtcgtcggctttgttgcagctttcgcagggcttcaacgccggtaagctgcaaggcgacgaattccgcgccgttgctgaaaatatgccaattgcgttggacgccgtagcaaaggcgcttaacgttccaatcaaccgggttaaggaactttcaaccgaaggcaagattacttcggaagttctttacgaagcttttaagataattcaagaccaagtagacgcaacttttgcgaaaacgacgcccacaatcggccaaagcttgacggttcttcgcaacaacgcaattcagttcttcggcgaacttgacaaagcgaccggctttactgccgggctttcgcgcgcgattatttggcttggcgaaaaccttaaaacagttgccgtaatcatcgccggacttggcgtcgcattgcttgtcgccttcggtgccccgttggttggtgcgctggccggtgcgacggctgcggtaaaagcctttacgctggcgcttgcttcgaacccgattggccttatcgtcgtcgcgctttcgactgcgattgcgtatctaacgcttttccgcgacgaaattaacttgggaatcgacgacgttacgacgttgggcgatttcttccgcgcgacctttgaaggcatcggccaagcaatcgacgacgttaaaaccatcgcgtcgcaattgtgggcagaacttagcgacttcgcaagcgcagcccttggcgaaattacttcgaacgttgacgattcgacttcttcttggtcggacagttacgccgcattctttcaaaccaaccgtacaggttgggccggtgcgctggaaaacgccgcaaaggttcttgacgcaatcgccgggcttttgaccggggccgcaacgttcgcaggccgtgcaatggccgaagttgttatttcggttcaaaacggaatcgcaaacgcttataacgttatcgcgggctggattgaaaacgtaacgaataaagccattgaagccgcgaacaggcttcgcgcaatggtcggtaagtcggcttacgaacttgtccaattcgaacgcatgggcagcgcaggccaaaccgaattcgaatcttggggcaagctttgggcgcaatcgctggaagacggatttaacagccaaggcggcgcaatgcaaaacctgttgaacggccttttcgaccgttcgcagcaaatcggcgcgcagcgcagggccgcaggaagcgcgcagcttcgcggggccggtgcgtcgcagcttgccggggctaccgacgcgaacgcggcgaaggctgcggaacgtcgcgcgctggcaatggaaaaaatcaatacgcagcttgacaacgaattggcgcgtatgttccagcttcaaccgcagcgcgaagcgcaagcgaagttcgaccaaatcgaagaaagcttgattcagaaaaagattaagcttacgtcggaagaagccgaagcaatcaaggcgaagattaaggccgttcaagacgcgaccgaagttcaacgccagttcgacgcaatttacgccgaagctgttaacccgttgaaggaatacaacgcggcgcaggaagcggcgaacaagcttcttcaaatgggcgcaattacgcaggaacagcacgcccgcgcagtaacgaaggcgtcggaagcttacgcaaattcgcaagacccgttgcggcagtataaccgcgaccttgaacagcaattgcagcttttgcaaatgctgccgaagcaacgcgaaatcgaacagcaggttatgcaagttcagaacgatttgcttgcaaagggcatcgttctaaacgaaaccgaattggcgcagcttcgcgaaaagctgttgcttattcagcaagtaaacgccgtttcgcagcaagaagcgtcgttgttggacgccagcgtaaacaagcgccaacagtttatcgaccaacttaaagcaattcagaacttgcgcaacaacagcggaagcggtttcaacgcaggcgaccaagccgaagcaactaacagcatgttgcaaggcatgggtattgatacaacgaactttcaaacgcagcttaacgcgcaattggcgcaatatcaaacttacgtcgaacagcttaaaatgctgaacgaacagcgtttgattagcgaccaagaatacgccgccgcaagtatgcaacttgaattgcagcggcaaaacctgtacttgaattcggcaagtagtttcttcggaaacttggccgcgcttcaacagtcgggaaataagaaaatggcggcggtcgggaaggccgcagcaatcgcgcaagcgatgattaatacgtatcaatcggcaacgtcggcttatgccgcgatggcgtcgattccttacgtcggcccggcgttgggcgcggcggcggctgcggctgcaattgccgcaggcttggcgaacgttcagcaaatccggtcgcagaataccgggtttaagtcgggcggttttaccgggtcaatgggcgtaaacgaagtcgcgggcgtcgtacacggccaagaattcgttatgaacgcatcggcaaccaaccgcattggcgttgcagaccttcaagccctgcaaacgggcgcggccagtgttcagcgcaacgacgaacaggcaatggcggctagtgtgggcaggggcggcaattccgaacccgcgcccgcgccggttgtcaatgtaccttttagcgccgttgtcgtacaatcgaaagaagcggccttggccgggcttaaatctgcggaaggccgggctttcattctggaaactatcgaacaaaacggcggcaccgtcgcaaaaatcgtcggagttaaataaatgggttacgcaattggaacagttacaaaaggcggcggcgacgattgccattatcaagttttggcaattatcaaaacgctggccgaagcgaacggatggacgacgcttcgttacgtatcaaccggacttgaccgcgaattgattttgaaaggcgttggtttgtccggtcttgaagaaatctttgtagggtttaagtgttatcaaagcgtcggcggcgattattacaatattaattgcggaactttcgtcggttacgtaagcggaaacactttcgaaacgcaacccggcgcgcagtttagcgcaacgcctgcccacaataacgcaattacgtatttcataacggccaacgcccaacgaatcgtcggatgcttcaaagtcggaacgcctgtttacgaacatttttacgtcggcaagttctttccgtatgcgcggcccggtgaatatccgtcgccgcttgtttgcggtgcgatgctttccaacgcgcaggcaatgcgattcgacaacaacgcgcagtcgttcccgtatccgggctattattacgatacgacgaacaacaggctttatattcgcgaccaagcgggcaactggattcgcccttggtcttggccgtttaccaacggaagttcgcaaaataccgcgcttgcagggccgcaaggaacttcgacgcttgttcctgccgacgtgtattaccaacttgaaccaataatcatggttcagcagaaaacgaacaatgaccccggaaacgtattcggcgaattcgacggcgtttatttctgttccggctttaacaacggcgtcgaaaacgtagttcaggaaggcggaagttctgtcgttgaccaaaccgggcttaccgtacttcaagccgtagacgctattaaggcggtcggcgggcgggcgtttgtaatgttgcaaaacgtctatcgtacttcttggcgcgattttatcgctttggaaatgaaataatggcatacattacaggaaccgccgcaaactttgcggatttgaaaacagccattgaaaacgcctgtacttctaacggttgggcgcttgccgacggcatattgtcgaagaacggttgtttctttcaactaatcgccgatagtttgggcggttatccgcaacttcgcttgcatggcggaacaggcaaaagcggttcgacgcttacaggccagccgcctagcaattacggggcaaaggttgcaagccctgtcggaaatcaaatcgtattcccgattaattacgaaatacatttgtttaccgaccccgacgaagtttattgtatcattaattacaattcggacttttaccaacaactttcgttcggcaagtctgatattccgggcattggtggaactggcgcatggtttaccggggcatatcggcacgactacgaattgaccaacgcaacttacgcccatagggtttttacggcgatttcttggggcgacgtaacaggcgtcgcaacttatgccggaatgtgcgtaggcttgttttttgaaggcaatacttcgcaaactggcggaagttatttcgcaagcttcgtacataccgggcttgattcgacgccttggcgaagcggccataacggcgacacgctgttaagcggctatcgcggggccggtctttccgtcggttcgcttttaatgtcactgccgaacatttcgaaccaagcaacgattttgcttcctattaagccggtcgcgcgtcgttcaagcggcggtgcaaccattatagcaaacccgaaaaacgcgcgttatctgcgaatcgacaacgttgtaccgggcgaaattattacgttcggtgccgaccaatggaaagtttacccgttttaccgcaaagacgcaaccgttcgaaacggcgtcggttggtcaaccggcgcgacgcatagcggaacgttcggatacgctattaaatacaccggaacttaaaaagaatggccggaagaattggaacatttttagcggcggaaagttttatttacggtgattataacccgaacctttccgccgaacttaacgaacttaccgccgcagaatacgcgccgacgatttacgacccgcgcgatatgttcttgcgcggcggatattcggcgtacaaaatcgcgccttcgaatcgctggcctattgtgggcaaagaacaaggcaacttcgggcgcgattattattatcgcattcatgtttcgccgttggtcttggacttgcaaacggtcgcgtcgtcccaaacgcgcgaattcaacgtttggaacgcatggcccgaccgtgcggcgaatcttgacgacattttggtaagcaatccggtcggtattgaaattacaggccaagcgacgccgtatgcaatgccgccgcttcaagaacttacttacgaaataaccgtaggcgtttcggggccgccgaatattaacgttgaagttcaatttgacttttccaacgttcccgacccgctgccgattctgattacaggaacgcgcgcggttaagttcgacattgtgcccgaagttccattgaacgaaacttgggaatggttaagcgacaacattgtagcggttgacggaacagaacaacgcatagcacttcgcggcgaaatgccgcgtattgaagaacggttgaaagtaattttcgattctgtcgaagccgtgcgccgtttttacggcgacgttatgtcggcagttggtcggctttggattcccgaatttcagtacgcgacccgaattactgccgcaagcaatagcggcgcgcttcaaatttattttgaccgaacgaagaccgacgttcgcgataccgaatacgtcttaattcaaacgccgcttgttgcggcacttgtcgaaatcgacgtattgacagccgacggggctacgcttggttcgccgctgttgttcgacattccggcagggtcgttaatcatgccgggttcgcccgcgcttattgacgacaatacagcacttgcgcggtattccgtcgataccgtcggcgaagtagaaattaacgcgaagatgattcgccagcgttcgcaacttacccgacccggcgcaaccgtcgtacttgaacagttcggcggcgtgccgattttgacgaagcgtccgcttgcaaacgaccttgtacgcgacgaagtttcgaccggccaaatttcaatcgacaatcaaaccggacttgccgacattattagccgttgggattatagccgcatcggcgggccgcgaagcttcaaagtaaaccgtatttcgaatcccgaagaattggattattggaaagcgattcttgcgtatgcacgcggacaggcgcgcaagttttggatgcccacatatcgaaccgatttggctttggccgtgcaaccgtccgacgcgacttcaagctataccgtcgaagggtcggagtatgccgaaaagatttggccgattatcacgcatcgttatatcgaaatcgaaacagcgtccggcattcatcgaaccgaaatattgggcgcaactttgcttgaaaccggcaatacaattcttcttcttggtacgccgcttccgaccggggccggatggatggaagttaagcgaatttcgtacttgttgcctgtacgccttggcgacgataaagtagaatggaagcattacggccttgaatcaatcttgaatctttcaattcgaacggcggaaccctaatgtctgattacgacgacaaagaagaaagcgtaggcgatagcgcgccatttgaactttacgaattcgtcggttcatatcgcaattattacatgacttccgacgttctggcgcacgtcttcaacagtgcgacatataacccggttccgggtttgaagcgcagtacgttaaaagtcggaacgcacgaagacgacaacgtagatatgacggttacgcttccaattacggaacaaatcgttaaagactatgcgtttcaaactacgccgccgtctttggttttgacgatttaccgtcgccagcgcgacgccgcaacttgggtcgcatactggaaagggccgattgcttcaatttcggttgacgacgaatttgtaacgttcagaacgccaagcaagttcggttcgatgctgtcgggcaatataccgaacgtttacgtacagccgccttgcaataacgttttgttcgacgaacgttgcaaggtaagccgcgtaaacaattcgctagatacgcaggtttcggcggtcgaaggtcgtaacatttcgattccgtcgcttggcggttttcccgacggttggtttatcggcggcgaaatcgcaatacctgcgcgcaacgaacgccgaatgattgtcgcgcaagccggggcaattctaacggtaaattacgaattcgcgcgtatttctgtcggcacttcggttcaggttacggcaggttgcgaccattcttacaacggggccaacggttgccccaagttcaacaatcaaccgaacttcggcggttgcccgtttgttccgggcgaatcgaataacgtatttcaaagcggggttcattaacaaatgtggattgcaattgtcttcgtcgtcgccttcttgcttatggcggcgcttatgccgaaaccgaacgtcgaaaacgcacgcgcggcgaaacttggcgacttccaatttccgcgttctaagtacggcgacccgatgccgctagtgtggggaacagtgcgccagaaatcgccgataacggcttggtttggcgacttccgcccggtgccaattcgtaagaaaatgaagaccgggctttttagttcgaagaaagttacggtcggttataaaaactatcttggcattgattgtattttgtgccttggccccggcgttcgacttcgtaagttttgggccggtacttaccttgtttgggaaggcaacctaacttcgtccggcgatatttacattaacaagccgaacttgtttggcggcgaagacgaacgcggcggcctgcaaggtacgatttcgttttacgacggtcgttttaacccgccgcaagattcttacttggtttcgaagattggcccgaatgttccggcttacaacggctttgcgcgtgcgttgttcaaagccttttatattggaacaggtacgacgccggaacctttcagcttcgaaattcagcgtattacgtccggcttgcacgcgacttattcaatcatgccaaacgggttggacgttaacccgatggaaattgtttacgacgcaatgacgcaaaaatggggccgattcggcaaccttgaaagcgaaattgatatgccttcgttcacggcctgcgcgcaaacgctgtataacgaaggcttgggtatgtcgcttattgttcaatctgcgattaccggaaaagacttgttggaagaagtaatgcgcgtcgccgacggcgtgttgtatcaagacccggcaacggcgaagattgttgcgaaactcgttcgccaagattacacggtttccgaacttcttgttcttgacgaatcttcggttaaagaacttcgcaacttccagaaaacaacatgggaaaacacttttaaccaatgccgggttacgttcaagaaccgcgccagtagttacgacgacagcgtagcaattacccaagacttcgcaaatatcaactttcaaaaccgcgttaagtctacggaagtttcgacgcccggcgttaccgacgcaacggtagcaagcaagattgccgcgcgccaactttcaattttgaacgttccgctttacaagtgcgacttgaccgttaaccgcaaggcgcagaacttgcggcccggaagcgtgttcgttctgaattggtcgccgttcggcatttcgaatatggttatgcgtgttacgaaaattgatttcggcgaacttacgtctaaccaaatcaagctttcttgcgtgcaagaccgcttttcgtcgtcttcgcttacgttcgcaccgcccgaaggttcaggatggacgccaattagtacggaaccgacgccggttacaacgcggcttctttttacgccgcctgcgttccttaccggatacgacgacagcgaaaccccggcttcgttcgattctgccgggcgtctgtaccttgccgcagttgcgccgggttctacgtccatttcttacgacgcaatgacggccccggacaatttcagttcgtcgcctattctgtcgcttgaaagcgccccgtacaacggcggcggcgtgttgctgaacgcctacgcttcgacagtcgccagcgaaacccgcaacgatacaagcggaagccttgtcgtaaccggcgtgtcgcaagcaagcattgaaggtttgcagcaatacacgacgctagaccaagcgcgcgacggttcggccttcctgttgattaataacgaactgttcgtttatgtgggcttcgttgacaatggcggcggtcaaattaccttcccgaacgtgtatcgcggcgttctggataccgtgccgggcaatcatgcggcgaacgaccgcgtttggttcattagcggaaccgacggactgttgccggaacttgtttcggtcggaacgacgcgatacgttaagcttttggatacgacttcgggcggcaagcttgatatttcgttggccccgtcgttcagcgggtcgcttaccaaccgggccgggttgccgctgccgccgcagtacctaacgcttgcaggaagccgcacgccaagcccacaagtaggcgcaacgtcgattgctgttgcatggcgcaaccgcagccgggccgataccctgttgcgcgtgtatggcgacacggcgaacacgcgggaagctggcaccgaaacccgcgttcgctggcgtgtaggcggcggcgcttacacgaccgttacgactgccggaagttcaacaacccttgacgtaacgggcaagtacggcacgctagaagttattgtagattcgttcattacgtcgaattctaaatattcgacgtatagcgattcgcttacaatgaccctaacggcaccgccgccgccgtaatcaaaagaacgacagcgcggcggttttggccttcttcaaccgcccgcagtcgtacaacatttcgaccgcttcgttaatgtaccaatcgtaatttatatcgtcgggaaattccgtcggcaagtccattacagggcgtgcgccgtcggttttcccgactttgtttccgctggatacgtaagcaatatacccggcttcgttcttcgggtaataccaacgaacaaccttgccaagataacgaccgttcttttcgccgccgccgcgcacgttctttactgcaacgaagcgccggaagtcgcggcattctttaatcgtcttttcgaccggcgttccgtcaacaaggaagcgaacaacggcgtcggaacaaatcagggtttcggggttcttcgaaagaatcgaattcaaggccgacccgcgttcgcaataagcgcccttcgtttttgcgcctagctgttcgtcgataaagcgcgcttcggggtcgccgccgtcttccttgattgcgacataactattaacgtcgcggctgaatacggctttataccgcgtttcttcggtcttgtatcctgtccattcttcccaagacgcaataagcgcccttacttcgtcgtgtcgcgatttgtgatacttagaaataatgccgtcggtattgccggaaataacttcgatgccgatttgttccaaagcttcgataagcataagcaacacaagttgcccggtaatcgttacttgcaacataagttgcggcgcgtaaagcgttgaatacttgttgccaagctttccgaagcttccgttaatggtaatcttcaagctgtcggcaacagtcttccatttcttcgcggctgcgcggtcgcccgccttctttgccttggccgcttcggctttggcatgaattcgcgtatttacgattttttcgtaaacggtcaagaacgcttcgcccaagtgcggcgggcaaagtctttgattaaggattgttcgcgggtagaacgattctacgtcgttgtctgccaaaattatttcgtcggtcgcatagtgcgccgttttcttttcggtagaatgcaaaccgcccatgcctagtttgtacgtcgaaccgccgatggttacttttagcttttccagttcgggcggcatgattggcgaccccaagccgtcaagatagaagcgggcgtttcgcacgacttccagcatttcgcgaagctgcgtcgtttgatagcaaacgaagtcgggtacttcgtaaaccaagaccgtatcggcggatagtgtgggcttctttggataatagccaaggactttttgaagttcggagttaataaccgcttcggctacttgcgcgtctgatttcgaccgaaggtctacgccgtattcttccgacatttcggcccgcaatttcaattcgggcgcaagttcgttaaacaaaagttcggtattcgaaaggtcgttgcagcaataaggccgcactatttcggcgtcttcctgcgtcaatacatggtcttcgggaaatggcaagtcttgcatacgttcgcaatgcaagcgccctgcgtacagcttcaacgaaccttgaagcggcgcaacttcgataaggtcgatatgattgtatcggccaatttgtacgccgtacttcttttcgaacgcgaatggcgttaccttttcggttccatagttcggcccgcttttaatgatgaaatcggacgcttctttaagcttcttgcaatctgcgccgcgtgcggctagttcaatcatcggcaaatcataattgcgcgaattgaagccgacgatacagaaccgccaaagcatccaaagaagcttcgtcgggttaaaatcatggtcggggctgcgttcgaatgcgacgaactttccgttatcaagcgacttaaacgctacgtaaaagaaatttacgtaagtttcaacgtcgaagacgaagacacttccggcaggcattgccgttagttcttcgtccgacataaattcgacaggccgcaaagcctgtcgaatgcttgcggccagcttatcgacgacgcggcttttctttgcaacgataaagccttgttcgttaatcatgcggaagccccttaaaacggtatgtcgtcttcgtaattgtccgacggattatgcgtcgcttcgctgccaaggtcaagacccataagaacgccgcgcaggttttcgccgaaaaatacgaccttgtttgcttccggtgcgaaatgcgctttcttaaacgcatgttcgacggaaagaagcaacttcgcagaaaagcccattcgttccggcaagccttcgattttgtacgtcgaagcttcttctttgtgcatcttcgacaaaaccgccccgtcgtcgaaaaatacgtttccgttcgggctaaacgactgaatcgcgcgaacgccgttgtaaaaatcgtcgggaaccggccaagggttcaagccttcaacttcgaagacgacttggtaattcgggtaacgttcgccgtaaagttgcgttttgataaacgccccgttttcgaaatagaacgttgccgacgacgccgaaaagccgaagccggtaagggccgggccagccttggcgacagcaaccgccgcgcacttcggaagcatcatgccgggcggaaggtcgatgccgtgccacgcttccagcaaggccgccccgttggtcgcgacggcgcttccggcttgcaacaagacggcggcataggtcgcatttggtgcgccgtctgtcgcaagccctgcgaccgcagcgaaggccgttttaatccggtcgtcgattgtggcgcattgcgggtcgggcgcggtaatcggcacgtcgtcgaagcccacacaaggcaccaacgcccggaacgcgccagacgatacggcaagggcgttcgcggtaagctgcgtaatcgacagttcttcgccgaccttcgacagcgcgtcgataaactgcaacgtatgcgggcacgctaccaagtcttcttcgataggatgcgcgacggtcaaaaccccgtcggaagccgccgcccaattgtgggcaatatgcccgaactgaacgttcgtcggcccggcctttttctgcgcgatggcaacgaacttcaacgccgccaaaagcgacgccgcagggcttggccccttggcctttttctttccggctgcggcttgcctgcgcgcccttggctttttcttcggctgttcggcggctggcgcttcgtcttcgggcggaagcggaatattactgtcgattttcattttcggccccttcttcgtcaagtttcgaaattgccgcttgaagatagttcgccaagtctagcgtttcttctagcgcgtgttgcaaccaatcgcgaagcggcaacgggttattatccgtcgttacgccgtactttgcaagtccgacgatcgaacgttgcaacagtaattcgcggttcttttctacgtttttgtcgggcgatgtttcggccatttgttcaccattcagcggaaataacttcgggatactttttgttcacccatacgcgaacacggcgcggcgtgcgaagttctgaaacacgctgcaaagcttgataagttgtcggcggcggttcttcggcgtgccgctgccgccaccaatcgcgcgaacgtttcgcagcaagccccgggtgttcaagcattataaattcgttgaacatttggaagccgcaaaagtaactaaccttaatcatcggcggtttcgttagatttccgtttgcgtcgcgcttttcgtgcaaattgtaaagtaccttttgaacgtcgaaatattcgactatcggcgcgtcgcttcgcagcggttccagcgttccggcagttgcaaacaacttcgtttcaaaagtaaattcggtgccgcagttgatacactgccgggccgcagcgtgattatatacgccgcatacgtcgcaaatacgaacgggcgcgtcgccgccgcctttgcccggtctgttcggaattcgcgggtcgttgattgggccaagccttcgaacgtttccggcaaagtccgcgtacagacaattttgtttgccagtatccggcgacggtcgggttccgcgtcccaacttttgaacgtgtttgcccggcgatagcgtcgggttcaaatcgccgataaagtcgattggtggatggtcgaaacccgttgtaagtttctgccccgataccaagccgcgaagttcgccagctttgaaagcgcgcaagcgttcggtattggtcttcgaaggcaacttggaatgaaccggcaaaacttccaagccgtaagactgaattacgttcgcgacgtgttcggtattatcaatgccagttgcgaagataagccaagtcgaacggtcgtaagctatttcggtcatttcccgaacagcgttaaaaacaacttcgtcggtatctacggcggcttctagttgcttgctgttgaattcgccagccgttacgcctactttcgacaagtcgatttcggttcgcgtcggtcttgcgataagcggcgacaagtagccttcggcgataagtcggttaaacgattcgacgccggttatatcgtaacaaatgtcggtaaaaattccgttgtcggtaataagccccattttcattcgatagggcgttgccgtaaatccgataactttaagatgcgggttaatcttgcgaagttcggcgataatgtattggtaatgcgaatcttccttgtcgcttaacaaatggcattcgtcgattaacagcaagtcgcgccaaccgaaatggcgaagatgcgccgggcgtccgtcgtcttcttcaagcccgcgtttaatcgcaggcgctacggactgaacgccgccgaatacgattggcataatcatatcgcgggaattcaagcccgccgaataaatgcccattggcgcggtcggccaaatcgacataagcttttcggcgttctgttcgattagttctttaacatgcgtaagcatcattattcgctgattcggccagtaaccgaaaattcgacgaataaagtttgcaattacgaccgactttccggttcctgtcggcatggcgacgacggggtttccgaccccgccgcgctggaaataatcgaatattgaatattccgcttcgtcttgataccaacgcggaacataaatattagacattctttgcaaccgctgtaattggcgaataagaatcgcaacccgtagcgatgaaatcgcccggaattacgccgttgtgaacttcgcaaaaccattcgccgttttcgacaggatttgcggccttgcagcttcggcagttcttttcaggaatcgcgcccttgtggcaaatatccttagccgcgcaatatccgcacttgtgaaacgtcggattatccgacaagcgcggcggcgcttcctgcgacagaatgatttgttcggccttttccttcatttgctggcctagccgatggtctagctttacaacttcgcaatgcaagtcgtcgtcgttcttgttaatgttcaggtaaagaacataacgaaaacgatattcgttgccatacgtcgaagtttgggcgaaatgttgcggcttgcttactgccattccttgcgacattaagtccgaaaaacctttgccggttccgttggtcttgaattccagcaaaacgggttcgtcgataccgtagcgttcgggaagccgggcgatgccgtcaagcgacccgccgaagtgccccataacgccggaaatgcggtattgtgggaattccaagccgtcggctttcgcgcgtgcgacgtgttgggcgtaatacggattttcgttcgtaataaggtcgcaacccaacggcagttcttcgccttccttcaatatgccgtaactgtcgctttcggcttggtaaaagaagccgtcgcggttttcgtaccaacattgaacgccgatgccttccagccattcgataaagcgggcttcttcacggtgcccacgattgaacaagcgttgcttgcgaccgtccgtcttttcccgaaaacaccaacggaagatataccaaagcttccgcttgcattcgtcgccaatcaacgacgcgccaaggtgccgacggtgcccgccgtcatacgtgcgaacgcaatattcgtctatatcttctttaatgcgctttgcaagggcggttgcaacgccgggcgcgtcaaggtctacgctttgccttcctgcgtcggatttcgtcggctgcgcgtcgttcagcgttaattgtgcgttcttcgcgtctttgctgttttgcatcgttcttcaccttgcgccgcataagggcttcgtaattgttcgctagataatccgccgaaagtgtcgcaacgtctttaagttggtctttcgacagccaagatatatggcattccgacgggtcgattcctaattggttcgcaagccaattgtacgccttcgcgcgcgacattaagccggtttgccaaaggcggtcgaattcgttatgggctttcgttcgaagctggcgcgttgttctgtcggccatacgacccaacggaataaacgtgcccggatggcaaccaacggcggcgcgacaatcgttgcaataataaatgtgcggccaattgccataagttcgcccgtaaatcttgtcgttcgttgttagttcaatgttaacagaacaacaagtatcgcattgttcgggcgtcggcaatgcgtcttttattttcgacataaattcgcatactccttaaaaagaaacgccggggccggtcaagaccccggcgaatctacgccgcgacggcgttacgccttaacgctggccccaaggtgccgcgcctgccggtgcgccgccctgcgcgggctggccgccctgttgccagccgccgccctgcgcgggctgctgttgggcgggctgttgggcaggctggccgccccatgccggttggtcgccctgcggggccgggttctgcgccggttggccgccccaagctgcgccgccctgcggctgttgggccggttgctgcgcgggctgctgctgtccgccccaagcggcaccgcctgcgggctgctgcggctggccctgcggggcaccgccccaagcgccgttcggctggccctgcggctgctgttgctgcggctgcgctgccggtgcgcctgcgccagccttgcccggttcgttcccgttcatatcgaagacctttttaacttcggtatactgcgggtcgtttttctgcgggccgacttcgataagaaacggcaggttgtgaagctgcgacgaatcggtaacttggaacacgccgattacgtggcagattgccgaaagctggcgatgcgcgatttcgacggtctgttggttggaatggtacaggttcaggcgataagcgccggtcgtgccctgctgcgggccgtcgataatccgcaagttcagttgcagataaccgccgtcgttcgccttgttggccttgacttcggaagattcgataactaccggatgcttgccaatcggcaggcttccgacgccttgggtcgggtcgtactgttgggcgttgaacgcttggataagttgcatgatgtttcaccttttcgaaaagtcttcgccattggttacggcggcgaagtaaaccgttttattgcatcgctttcgcgaacaatgcggtaaggtcgggttgttcaagttcgttaagattgcccaaacggtcgcgcgcgaaaacttcgggaatttccttcgttcgcagcgcccgaaccggcttcggcattccgggtacgcttgcttcgcccaagtgcataacgttatcgaacaaatgcggaactttaacgttaaggtctttgcccggaaagaacgggcgtttttgcataattggttcgtaagtaacttcgccgttctgcaaaatcgtttgccgtccgttttcgacaagggcttgtttcgcaatcattacgatatgcttttgcggcatgtaatacaagtcgttcgcgattttcattacacgttcggacatattgccgtaagccttcataccgtgtttaaccttgcccaattcgtcggccaagataatttcggcgatattcgaaatactgtcaatacccaacgtatcgaaattcgcagcttcgcgcgatttcataaaccattcgaagaattcgacgataagcgcgggcgaatacgcttcccatgcgggaacgttcgaaccgcgcatggacagcataccgggttcggtcacaagcaaaaccggacgcggcgcagtattgataagcggcgttttgccggaaccgggcgcaccgaatacgacggactttacgccgtagcggcgggccagttgcgacgccggttttaattgcgacatttgcataacttgcaccttcgggaatggccccggcgcttgtgggcaaccggggcggggttgttacttcgacttcggcgcgacaagttcaagcgcgggcgttgcttccttcgacgttacaacttcgtcgataagcttacggaacttgtcgggaaggttcttgtattcggtaacggaaagttcgggcttccattttaccaaacgttcggcgataaattcgccttcggggccggtcttttcgattttctgcaaagccttttcgacggcttcttgtccgcctgcgaagctgcggttaatcttgaaaacggctttcagcttgtaacctgcgccaagttcgacgttttcggttccttcgcgcaaagcttcggggtcgaaagcgaaagcgtttttaagaacttcagcgcgcaatgcggattcgacttctttcgctgcggcaagcgccttcgttgcttcctgccattgcagaatcaaagcgtcgcggttagcgttttcgttgaaagacattgttgttactccttcggttgggccgccgcacaattgcgccggtatgtacgaactatacgacggcccttcgttgctgtcaagccccttgttcaagaatttttcgttcttcgaacaagtcgcgattgttggcgtcgaattcggtaaaagcgttcgggaagcgacgacgaagcttcgcgatgttgaccgactgcgcttcgccgaagttcgaaccgatagcacgcagcaaaagggcatcgtaccaaaagccgtcgccgacttcttcaagcgcgttaacagcgtcgaaagcttcgccttcggctgcggcgcttagggcttccaacagttcgcccgcttcggtcgctttgccgataattgcatgaatgatattcacggcggcggcgtcgtcttcggggcggtcggaaatccattcgggaagcttcaccagtgtcgccgcgttggcttccggggccggaacgccagtgtcgcgaccgtagaacatggctttcttgattgcgtcaagcttgttaagggcttcgacggcttcggcgatggtttcgcggaagtaggccagcggcacgcggtcgccgtaatacttgtcggacgccgtaacgtgcgcttcttcgatatagtcgaagggctttgcgggttcgttcatacgttcaccttttagaagggccgggcaccatgcgccagcgttccagcactgtaaccgaccgcgcctttcctgtcaacaacaattgacagcaagcaagaagccgggtaagctgcccacaattgctagaaggtggcgttatggacattgaagaacttacgaagcgggtaaagaaagcaagcgtcgggcggtcgctgcgggcactggccgcgcaatgcgacgtttcgcacgaacttataagaaagcttttgcttgccaattctgcgccgaacataacggcgacgacttataacaagattgacaaagggttggcaaagaatggactttaacaatattccgcacgaaatgcggatttacccgcaatgggtcgtttggcgatacgaagacacggattcaaagaaaccgacgaaggttccgtattcagcaaaaaccgggcaccttgccagcgtaaccgacccgaacacttgggccgggttcgacgaatgcgttaacgctatgtcgtccggttggtatgccggaatcggtttcgtattgactgaaaacgacccgtattcgtttatcgaccttgacgacacaaaaggcgaccaaacggcgcttgaccgccaaataaagatttttaacgaattcaacagctacgccgaacggtcgccttccggttcggggttgcatatcatcgttaagggcgcgattccatcgggccgccgtcgttcgtttatcgaagtttattcttcgcttcgttacatgacaatgaccggcgacgtttaccgcaatgcaccgattaacgattgtaacgaactgttgaacattctttggggtcaaatggggcaaggttcggttgccgttgcgcattacgccggacttgccgaagccaaggaaaccgacgaacaggtttataaccgcgcagtcgccgcagccaatggcgacaagttcgccgaactatacgcgggcaaatgggaaggcatgtacgcttcgcagtccgaagccgactttgccttggtcgatattatcgcgttttatacgcagaaccgggcgcagatttcgcgaatgtttcgcgcgtcgggcttggggcagcgtgacaaagcaaaacgcgacgattacgtttcgtacatgctgaacaagtgtttcgaccgcatgttgccgcccgttgacgttgacggattgcgcaacaagctagacgaagcaatagcaaagaaagaagccgccgacagggccgccgcgttgtcgcagaacagcgaagcgacgccgcatccgaaagccccgaccccgaaccttaacgaagtttcgaaggtatacagcgtgccgcccggattagtcggagaaatcgcgcaatacatttacgcacaagcgccgcgcccggtgcccgaaatcgcgttggccggtgcccttggcttggtcgccggtattgtgggcagggcgtacaacatttccggcactggccttaatcaatacgttctgttgttggcaccaaccggaacaggtaaagaagccatcgcaagcggcattgataagctaatggcgcaggttatccgaaccgttccggctgcgtcggatttcatcggccccggcgaaattgcttcgtcgcaagcgattatcaagtatatgtcgcgcgggccaacgtcgttcgtttcgttggtcggcgaattcggcatttaccttcaacaaatggcaagcgtcaacgcaccgccgcaccttaccgggcttcgtcgcttcctgttggatgcttacaacaagtcgggcgaaggcaaggtacttcggccttcgatttattcagacaaggacaagaacaccgccgcagtattggccccgtcctttaccttgcttggcgaatcgacgcccgaaaagttttacgaaggtttgcacgaaggtttgatttccgaaggtctgttgccgcgttttacgatgattgaataccacggcgaacgcccggcgttgaatccggggcacctgtcggcccaaccttcgttcgaacttatcgacaggctttcgaccttgtgcgcccatgcgctaatgctgaattcgcagcataaggcgattcacgttcaaaccgacgcaaccgcccgcgaactgttccagcaattcgacgcgcattgcgacgcgaacattaacacaagcgaccgcgaagttcggcggcacctttggaaccgggcgcacgtaaaggcgttgaagctggccggaattatcgccgttggctgcaatccttacgacccgaccattaccgccgacgttgcgtcttgggcgattaaccttgtcgtcgccgacgttcgaaacttgcttgcccggttcgatgctggcgaaattggcatagacaacgacgaaacgaaacagcttgcgaaggttattgcaacggttaaagatttcgtcgtttcaccttggccggacgttgcgaagtacgcaggcgaaggaatgtccaaccttcattcgaaccgaattgttccgtacagctacgttcaacgcaggcttgccgctgttgccgtctttcgtaaagaccgcatcggcgcaagcggggcaatcaagcgcgccttgaagaccctttgcgaacgcggcgatttgcaggaagtaagccgggccacactggcgaaggattacggaacaagcgccgttgcatacatggtcgcgcatccgggcgttttcggcctgtaacgcgcgcccgccagtgtgggcagaacgggccgccttcgggcggctttttcgtgcctgtaaaaaagttcgtcgtacctgttgacgtagcttcgaactgtacgtagaatacaaaccatcgaaacaacgaacacaaccccgaaggagttacgaacatggcaaacatcatcgcagaacttaccgcccgtatcgaagaataccgcaaggacaacaagaacccttgcaagaattacaagaccgaagccgcagccgaaaaggcaaccgcaaaagctgctgaacatatcggcaattactttgccaagaccggcgaaggccgccccgcccgctacgtcgtgttctacgttgaagcttggggccgttgggttggctgtatcgaactttcggaagttctgcgccgtcccgaatcgacaggcggctatcttggaatcgaaccgggctttttcaagttctaaccccggccccggcccttggcacgcgctaggggccgcgcagcctgcccacaatcaacgaaaggagtatgcaccatgaccgacacgccttggccttgggaaccgataccggaacctgtaccgcgcaagccgcttacagtcgccgaagctatcgcgattcttcaaacaatgccgcccgatgctactttgctttcggaaggctgcgattgtatcgacgattgttgcgacatttcttacgatgcttccgaccataaagttctaatggaacgataatgcttcaacttgaccgcttcggcggtctttctttttctacggcgtataatagcaacaggcattcataatgcccttatattggcctaagtcgttgatttccctagaagtataagattcataacgtttaacgcccttgggcttggaaccgtaaccaagtaacgcatattccgttagattaactaaaagaagaattcattattatattcattcaatttattatatttcctttattttcaaggacttagggactatacagacccttcaattcgtataaggggcaaaaagcgggttaatgtaacgtttgtctaacgttatgcttgacaggctaacggcagtcgattagacttggcatacttgttaaccaaaggagttcgtatcatgcctattcaaatcgtcgaatcttcaccgaaggcgaaagaagtaatcgaaaccaaacgcgaacagcgcgcggaaatgtacccgtttgaacaattggaagtcggcaagtcgtttaccgtgccgcttgacgaatgcaattggaaatcgcttcgaattattacgtacaagcgaaataagaagtacgaaggcgaacgcgaatttgcctttatcaagcatgacgacttgaagttggccgaagtggcgcggctgaaatgaacagcgaagcgcggcccaatgtgggcaagccggttcgcgtgtatgggtcgtcgtatcttggccttcgcgcgcagtatccgaacgcctttgccatccaaccaacccggacaggctatcaagccgtcgtaatgattgaagaaggggcgaacaatgtacgaaatcgaaaccggccataaagtgccgaagcaacgtcgtaaggctggaagcgtgccgaaggccgttcaacaggcgttcaacgactacgccgacgcatataaggccgtttacggcgtgcgcccgctgtcgttcacgtatgaccgcgaaagcggctttattcgtgtcgaaagtagcggcggcgtaagcgtcgcaaggctgcgcgaaatgacgaaacagcttcgttaccgcaaaggctgaaaaaagttgttcgcaggtattgacgaagcgtcgaaggcgtcgtactatag

SEQ ID NO: 13 - DNA, 76081 bp, unidentified
  misc_feature 1..11: note = bacteriophages nucleic acid sequence
  source 1..76081: mol_type = genomic DNA
atgaacgtagatccgaaaactggactgatcacccagaagctggatgaatggttggatggtgtggactactcggtgctcaacagtccgagctacatcccatccaccttcgccctgaccttcatgaactggatcaagatggtcaacggtgacgtgggggagagccacaaaactccccctgttcacctgaaaatgctggacaagatcgtggatattaacccgatcaccaaggccgtgaacgcctacatcgccaacctctgcttccggggtgcagccaagacgactctcttcatggagtacttcgtcctgttctgtgcccacttcggctacatcccgaatttcgggaaagtcgaggggatgatctacgtttccgactccatggacaacggagtgaagtcggcccggaagaacatcgagttccgttacaagaacagcgagttcctccagtactggatccctgacgccaccttcactgacaactaccttgagttcaagaaccgtgaaggccacgtccttggctgcaaaatgttcggtgctaagaccggcctccggggtacgaagatcttcggtaagcgtccgaccattgccattctcgatgacctcgtgagtgacgatgactccaagtcgaaggcagccatgcaggcgatcaaggacacggtgtacaagggtgtcaaccacgcactggacccaacgcgacgcaaggtcatcttcaacggtacgcctttcaatgtggacgacatcctcatcgaggcagtcgagtccggtgcatgggacgtgaacgtctggccggtgtgtgaagcattcccctgcaccaaggaagagttcgtgggtgcatgggatgaccgcttcagctacgagtacgtgcaagagcagtatgacatggcagtgaaaaccggcaagctcgcagctttctaccaagagctgatgctccgcattacctcggctgaagagcgactggtacaggacgaagagatcggctggtacgaccgggccgagttgctgaagcacccggagcgttacaacttctacatcaccaccgacttcgccacctctgccaagcagactgccgacgactcggtgattgcgagctgggcctacaacgccaaccgggactggttctgggtggacggcgaggcagagaagcagacgatggagaagacgatcaataccctcttcgcccacgtcctccgttacaaacctcagcaggtgggtatcgaagtcaccggccagcagggtgcgttcatcacttggctccagcaggagcagatgcgtcggaacatctggttcaacttcgccagtgatcagcagggtgggcaacccggcatccggcctgtagcggacaagctggcccgcttcaaccttgtggtcccttggttcaagatgcacaagatctggttcccgaaagagatgaaaggttccaagattgtgggaaaatatctggagcaaatccggctggccacccagtctggtctgaaaggcaaggacgactgcatcgacacgatcagccagctggcctacctcaagccatgggttccatcggaagctgccccgcgaactgaagaggaactgtccatgtggcaggaccagttcagccagcctgaacccaaccgaatggactcctacatcgtctgaggccctatgcaaatcaaagacttgtaccgcaacctctcctacggggtactgaaaaacctcaccatttctggtgaggggagtggtgacatcatcgagaaaggccgggggtctgtgatccttgctgccaatgaggcgttgctgcgtctgtactctcgcttcctcctgcgtgagaaggacgtactgatccgtcaggtggatggggtgaccaactaccatctgctgaagcggtttgccgagttcacagaaccacgggtggaacgacacacctacatcatggacatgggattggagcccttcgaagaagacgtaatcaagatcatcgctgtgtacaatagcgacggttaccagatgccgctgaatgacaacgaagctccatggtcggtgttcactccgcaggcgacggtgctccaagttcccaacccggaaccgggcaaagccttgtcggtcatgtaccaagcacggcacccggtactggaagctgagaagctggatcaacccatcgagctgccagatgttctgcacggtgcgttcttcagctacatcggctaccagatctacaacgacatgggtactgccgagtccatggccaaggccatgaacctgttccagaactacaccttgatctgtgatgaggctgtggcgaacgactccgttcaaaccagcattaccacttccaactcccgctttgaaaaacgaggatgggtataacatgcgtccaccattcgacccagtaggtgggccggacacgctagtagacaagatgctcggcaacgcttacgacaccgtaaaggccgttgccttgaatctgacctacatcaagcacgtatcggaccagctcgaaaacatctacaacgtcagccaagaactggtggcgattcagaatatctccgacaatctggaagatgttcagaagatctacccctttacccaacagatcgcagcagttgctgccgaactggacgaggtggtggctgtctccaacaacctgacccagatccttgtggtctaccaagcactaccgattctgcgtgaacttcacgctgaaatgccggaactgctggagatccacgcgaacctcggtcgtctgattgccgtcttcgatgccttgcctcaaatcaagaacgtcgaatcccagctggcaatgctcaacagcatcaacgacaacctcagcgacttgctggtcatcagtcagaactccagcactctggtgcccatgagtcagaagctcactgagctgctggatatccacagtaacctgacggccattctggctgtgcaggcgaacctgactgctatcaacgcagtggcgactgatatcgccaaggtgaacaacgtctcgaacaacatgacggctgtggctggtgtcagcagcaacatggatgccatcaccaacctcaatgcggacatcgctgctgtggttgccgtgaatgcccagctggctgctatcgagaacgtgaacgccaacatctcggcgatcagtaacgtcaacacgaacttggcctcggtcaacagcgtggctctgaacatgggcagcgtcacgtcggttgctaccaacatggcagacatcaacgccgtggctgatgcaatccctgacctgaaggctgtcctgaagaaggaagtggttgtcggtgcagctgactcggccaccaacatcccgttggctccggccaacattggcaacatcttcggcatttccgggatgctggtgggcactgatgggaacgtgtacttccccgatgcccacttcaactactacgtgtccgggtccaatctggtcgtacagatcaccaccggtgccccatctgcaatggaaggcggtactgcacgggtggtcattcattacgacccaacgtaaggaactgtcatgagcgaccgtccatatgctccactggatgcgttcactcacccacgggaccactcttctcgggtggtccctctctgggtggatgggcacggtccatacgagttggccctgtctgaccatacgatggcattcggtggtcggctggttgataccccttcggacccaatggtcttgaagctaaccaacactggcttccaacctctgaacgtactgtcgatcaccgtcgaaggaccgttcaccatctctggcttcgaaccccatgaggtcaagggaggtggtggtgtttccttggttccagttgtcttccggcccccggcgtttggggtacactacggcaagctggtcattaccacgaaggaaggtctggtcaaggaggtccggctccttggagccgggatttgggactacgtgaaccaagtggaccaagcaatctctgacctgtggtcttttctgcaacgggctacccgtccagcactgactgaatccggtccgatcattgacttgggcaacactggtgtcgagttcaagggagaggtcgctgttggcgaagactccactgacttcgactatgtgatcgccaacgccggtaaccagcccctcatcatcgacaatctcactgtgaccggggacttcgagatcattccatgagcatcactattccagcgtttggttcgcacaccatcaagttgcgattcaagccgacggctgagggggtacgtcagggcaacctgacgttcacttccaatgcaccgtccagtccacacactgtcgccttgcttggctatggcaagtcttcgggtggtgggccagaccctgagccgggcggcaacatcacctacctcactgccgatgggggcaagctgcgagacaacaagggtgagggcaatgttgtaaccctgaagtccatcaactggtatggtcttgagcagatcgggattcctaccggtgcatggacccgcccattccgtaccaaggtggtcaacggtactctgcgtgaaggcatgctcgacgagatcaagcgtttgggcttcaactctatccgtctgctgttctctcaggactgtacgtgggatgggtacgcccctcagactgccaatggcttctggaacacgacgtacatcaacccgaacatgaacggggagttcctgaataaccccactcaagaaaacccccaagcggtcaagtccaccatcgagatcatcgacatcttcgttgcatggtgtgaggaactggagctgcgtgtcatcttcgacatgcacaccctggctccagatgacagtaacgtgctggccaccaacggtaagtggtacaccactgcatcgccgggcctacccggtgcgactgctggacagaaacgggaacctcgtaacgaggctcaagccattgctgcccacgtgttcctcgccaaccgctacaagaaccggccaattgtctgtggtttcgacctcatcaacgaaccgcatgcttgcacgtgggaccgtgaccctttgactggtgtactgggcttctacgagcgttgtggcaaggccatccacgccgtaaaccctgacgtgctcatcatctgtgaaggtgtgaccggcaacgtcgatcagaccccagcaggacacgaaaacgatccagaaagccagcagggcttgtacgactggagcacgtggtgggccggtaagctggatgacgccggtagcctgccggtgcagctcgacatccccaacaaggtggtctactcgccacacgagtacggtgcctacctgatgggtgtggccatgcaaccttggttcaaccctgaagaaaaagtcggtgccggttatgccggtctgccctatccgcagaacatgactgaagtctggcgtcgtcagtggggttacctcgccgaggacaacattgcacctgtctggattggtgagttcggctcctacctgcgtgttggtggtaacccagttactggtggtggtgctgactactctgagatccatttgcagaaggacgaagcatggctgaccaatctggctgcctactgcgacctgcacaagatcagcttcgcctactgggcatggccaccgggcggtgaccctgacggcctgctgtctcaggaagtgggtggtgcatggactgctgctcagcagttcaaggtggactacctgtccccattcatcactccggtgcctcaagcacaagtgactgcttccccttcgacggttgcctttggtgaacggcagattggtagcagctactcgatgaatctccagctacgtaacatgggcaacactccggtgaacgtggtgtcggtgtcttccggcacgggcttctctgtggtgccgagccatgggactgtgcctgccttgggtgtgctggatctgactgtctcgtttgctgctctgactctgggtgctgccaccggcaagatcaccgtgtcctacggtgtggaccagaccattgaagtcccagtcacggccacctgcgtcaacaaagatgaaccgggcgtggaccctatcgtcatcgacctgccgccgaatgcgtggggcatcactgctgtgggtgactccctgactgaaggtggtgcctacttccacaatggctggctggccaaggcctgcttctacggcaaccagtacctacgcgaccgcaacaacttcgctgtgcccggttccactgtggaacaggcccagacccttcagctgccgaacgttctggcaatgaacccaccaccgaagatgtgcgttgtagcctctggcaccaacagtgtctaccaaggtgcggctggggtggagaagatcaaggagatctgccagaccctcattgctgcgaagatctacccggtcctgtggacgctacctccacgcaatgacaccacgtccatggacagcaacatgattgcgtggaacgacgccatcaaggcctaccaccgtgagactggtatccctctgctggatgcgttcgaagctatgcgtgtaccgggcagcatgcgtgctcaagaagccctgatgaacccggatggtctgcacttctccaactacggctacaccgtgttgggccgctacgccatcgacagcaaggctttcactgctgctcccactgacggacagattgccctgcctacctctgtgggcggaagtaacctcgtccctaatccgttgttcactggttctgctggtgtgtctactggcctgactctggcgactggattcactggtcaattgcttccagctgctgctggtaactggcagcggatcattcgtccggctggcttgactggcaacaacatcaccaacaccattgaactgttcgctattcctgctggcaaatccctgtcccttgcatgcaaggttcgttggaatgctgctggcttgaagggtggggtgaacatggtgcggtcggcatggcaactaggcatgcaggtcatgttcactgaccagagctgggctgacttcccgaactcgctcttcgtagtagtgggtccacaaggtgacgatgtggaagaaggaaccttctacatgcaactgactcccccaactggggcgaatcgactgatggtgcaactggtgtctttgtccaacatggtggaggcccataaccaagacattacgttcgacatctcccagctggctgtggtcgaaggacaatttgctttcaacagcatcgacccaagtccaaatccaacggataatccaaacgcattgcgggactcgtccaacgacatcctgctggattccaactctgaggcaatcgagagctgatatgggcaaactcaatacttaccagctgcaatcgcagctggctgccactctccaactgattggcatcattccgggcgaaggctcggctttcgagactgtgcggctgtcgaatgctgcactcgtctccttcatccagcaatacgctggcgaagacggcaatgatggccgtgagatcgaattgcgtgcaggaagcaccgacattgaatggcgttacgccggggccacctcgtggactgccctgatcgccatcaacgacctgaagggtgcagctggtgaacaagtccagttgcaggcgaacgccacgcatatccagtggaagtactcgtctgcttccacgtggaccaaccttgtggcactggccgacctgaaagggaccaacggcaccaatggccggactatgtggtctgtgtctggtgccccatcctcggcactcggtgtggatggtgacttcgctaacgatgccaccaactccatcatgtacggaccaaagacctctggtagttggggtgctggcaccagctacaagggtgcgaaaggcgacaccggcaccggcctgaccaaccgtagtgcatgggtttctgggaccgtgtacaaccccggcgactacgtgttctctactggttcggcgactgccagctccatgtggatcctgaacggtgaagtgtcctacacctccaacaccctgccgaaggacgacctgacccactgggtggagtttgttgcaccggctggtgctgatggtgaagacggcaagtccgtggaaatgcgaaagacggccaccgttattcaatggcgtctggtcggtgacccagcgtggactgatcttgtgacgctggcagacctgaagggcgctgacggtaacgatggcaccaatggcaataccgttctgtccaccactggtgctccttcgtctggtttgggtgctgatggcgactttgccatcgacgtgaccaactcggtcatgtacggccccaaggctggtggtgcgtggcctgttggtgtgtcgtacaaaggtgggccgggtgacgctggagctgccggttccaagtggctgactggttctggtgagcctgactccggcactggtgccgatggtgacttctaccttcgtgacacgggtgacgtgtacgggccgaagactgctggtgcatggggtgctgtggttgcctccttgaagggacccaaaggagacactggtgatggcggcggtggcggttcgggcgatgtgaccaaggcaggtaacaacgccttcaccgggaccaacagtttctctgctaaggtcactatgtctaacggtttggatttgagtggggtctttaactacgctggtggcaccatgctctacagtggtgtatcccgtaaggccggtccatcggaaggtggcactttgtccccgactgctggtgtttcccagcaagtaatcaccatggctgctgatgttgctgctgcaactatcgctttccccaacgattccacgttgggcattgagatcactatttatctggagaaagccattacctccgttacttacagcggtggcaccatgtggggtggtagccaggcagttgcagtagttggtgccccatctactctccgtccgggcgggcacaccttccgattgctcctttctgaaacgccagcctggtactacatcaactaacctctagcctgttagacttagcccggtcagttccctgaccgggcttttttattcacagaggaatcctcatggcttctactcttccaccactcatcaccaccgaaggactggtcctcaacaaccagatgccgggtgaaggtgctctgggtaactacacccccaagggcacggcatcgtctgaaggcatctcccttctgatgcgtggcatcctccgggcagcacatgccacgggcgataccactatgaaggagtatgcaaacttcctcttcgatgccgcctgcaagtacttcttcaagggccaacgcccaccggctgaagctggcgaaggctggcatcacagctggatctgcaacggtggtgctgctttccaagtgcgtggtccactggctccttctggtgatctggccttggccgggtacatctatggccgtgatcccgaatcttccatccagttcaccaatggggttggccagctgaacccggctccagacatctgctaccaagtggtcagccaagatgctgcttttgtgtggccgaacgtcttctctgatctgactgctggtcagacctatgaggtggactactacatcgactccaagggcaacaaggtgttcggcactcagaagggtggctcctttggtcaaccctccattcctgctggtcagcacgatgatggtgctccgggcaagatcgtcctgaagactcctgtctccggcaccctcggtgtcaacttcaacgtcacggttcctgacgtggttgtggcttatggtgagctgtatgaagcatggcccatgtggcggaagctggcagatgaggaagtctcgacggcagctgatgctatccactggttcatcgacgcattccagcttggtcgttccttggatccagccaactccgactggaccaacgccctcaaccgtatgcaggaagtctgggaaaccacctgcaaccaagagtccaacagcaccttgatttttaaggccggagcagacggtccgtacaataatttcccgcttacttacagctatggctatggccgggacaacatcgacaacagcagcaccaattgggatgccgtaccccccactgatcgttacagcgtgcaacgggaaagcgatggctacgtgacctttgtcatgcccaaggaagatgctgaagctgggacgggcctgccaattcgctatggtatcaccttcgaaaacaagccgttgtatctggagtacacgcaaaacagcacgctcgtcttggacagttactcctcggtggctcagacgttggacgtggtgattggtgatgccactgacaagcagtacacggccactgtgttgctgggtactgttcctgatacgccagtagaaattggtgttagtcagttcctgcaattccagcaacaacctggggatgcatcgggtacgcagaccggtgactggcatggtgacgaggacttcgttatgccagtgtacgatccggtgccgtggccgggtcgtcgtatggctaccgtgggtgactcgatcactttctataactgtgcccatatcgaccccaaggctggctccaaccgctatgaaaactatggctatggatatgctggctggtgggtcaatgctgaacaaatcatgcgtggccggaccatgctggaacatggtattcagcctaatctgactggtaagcaccggggcaccagctttgctgtggccggaaccaaggtgcagaactggtggttggcacaggacttcccagcctcgcccaacactccagaagtggggccgatgtacgctgccctacagtacctcaacaagtacgacatggtggccatgcttggaggcaccaacgacctgtcgggtaatgccccggccctgcatgtgctgaaccgactgaagcgtgcttcgaccgatctggccaagaatggtaagtgggtgttcctcggagtgatccctccacgcactcggtgggaactgcgaggttacacctacattgagcagactcagattctggaacgattgaaggaagtgaaccaagggctgcgtgactgggttaccaacgatcgtccaccgaatatcttcctcgtagactggtacgaccgtctgcttggaccgaacggccaagatcctgctggtctgcaatcccatgcctctgacccaaatggtcttgactcgctgggcaactaccgtgcagacgcccctaacttggtgttcttccacgatgggttgcatcccggtccagctggcgctcggatcatgggtgaagtgctggctgaggttatgattgctgccggtgttccagcaagggacaacaacaacacccttgggcctttgaccctcggtccaaacttgttgtcgaatccgactttcggtttcacctcgtttgacaccaccatcaacaccagcaactacaatcagtctgatatcggatgggcttacggtttgggccaacaggtcaaagtgggcacgctccacaacggcttcacgtatggcaaagtaccaaacaactggaagttctttaaggccaccaatcgtgaaaatgtgcctattggtaatggtgttgggggtgtctacgccaacttcatgagctacacgtatggtgatatggcggctgagttcccggctattgtgccttacatggctgacccaacttggcctgaaggctcagtgcgagtaactcttggggtacatgggggttcgccagctctgatcatagacgttgatatgcctgtgacgggtaacaagaatgagtctttcgtgttggtggctgacatccctcgccgtcaacatgggccatgggataactacggttacaatgggcctgaccaaaacatggtagtcatcaacaccacgtatttccccggagatatgctgttggttgagtctgacattgtatttgaaaacctcaatgccactctgcatagctgccaacaggtgctctacttctaccagaacaacccaggtatttcctttggttctaagctggcatcgttcggcaaccacccgttcatgtatccaccttcggacatggacaagatccggttgcacactaagaaccggacgatccaactgcgttccccggcgatccgggttccacagacagaggcgggtgaaaccatgcagtatgctgaactgcggtatgagattggcttcgatgcctcagtcatgggtccgaaagggcgaatcatcatcaagaacccttccgtgcggaaggtcaccggaggtactccactttgacggcctataacgtatggctgcccagtgacaaattttttggctacaacaacggggtacaaacctcgttgtcgtaccagagcactggcggaagtaacaaactgctgtgccgtagcttcaccattccagacttcgagtctggttttgggatcacctacgaccagatcaatccggcttttgctatcactaagccgcccaagatctgttatagctcgacggctgacatgaccctagcaatcaaggatagcgatggctggctatggacggcgaatatgcctgctcaggctgtggtcaaggaacgaggctgggcgtggagccagttcatccttggttctgtacaggaaaacaccggggaacctccggtgtccccggcgactggcaacatcttggccttccagattagtggggccagcggttcccatggaccttctgggaccgatccagtcaccgtgcgactggcttatgtggccgggcgtactccgggcgtagcttcagcaggcaccattcgccaagtagtgttgaccgacaagaacccagcagcccatacatggaaggtgggaaacatggaactggtcaacggctctcgccgggaagtgaagtacattggtgctctgccattcggcctgcaaatgaacggtccccgtaatcgtctgtcgtcgttgccgtaccgtggccctatcgtggctggttaccagtcgggtacgccatgggtgcatgagaacaacaacgaaggattgagcggcatgctggacttcatgctggattcccagttgcagttcactgcccggagtccccagcgtctggtcggtccgttcatgcacatctacctgcaagccctctgggactgtgagcagaacggtgagatcgacacgtgggtgtgggatggcccagacggtaaccctgcatgggatggctggcagtaccgggcaatcgactccatgggccgtacttggtacgagatgagcctcaacccacagatgtcggctgagaacatggagaagatcgagatgatctgtacccagttcctcgactggctgtatcagtggttcatcgaccacgaggaagcaaacggtgttcccaacgactggcgaccaccaaactggacccaagggaacccaatgcctgcgtccagctacctcgatccgaagtacactggcccgtctgcccatgacgatgcactggcactgaaaggtgctctgttctctctgcttgctggttacaacagcctgaagggtcgctacatcgttcaccgtaccttgtcggctctgctgagtctgcaatactctggtgaggatgagatggatggggcattcactcagaacccaacgggctacgaggtctatggctttgaacagggggagatcttggaggctctggccttggccaaacagcacccggaactgctcagttccccgatgactgtcactgagtagcactttgatattgaggggatttacgcaataatcccctcggttttacttataaggaaaatccgacatgaccggggagtcgcttgaggtaaagatcgcccgactcgatgaacgtctccagcgtttgcttgacgagtccgagcttgctcgggaggggcgaaagcagcagtacgagaagctggagcaagtgaaccagacggttacccaactggagtctcgggtaaagggagtggaggatgggctgaccaaggcatcccccaccattgatgagttcgtcaacatcaagatgaaagtccaaggtgctggcattgtcggcaagtgggtttgggctgcgggtggcactcttctgggtgctctggctgtaggccgtgaggccatctttgcttggttttccaagtgatccggccaatcgagaactggagaaaggcatggaagtttgcttcagttcagtggaatgttgttggtatcctgtgcatgctgctcgaaattgtgcagcagacatggcaatcgctacccccggcgattgctgagcagattcccaattcgtctcacgtagccttggtcttgtttcttctagctacggtggggcgactcatcaagctgaaggaaaaacaggatggctcttcctaagaagacactaggtgcagcaacggcagcaatcctcgctgccgtttttgctatggaaggtggttacgtcaacgatcccaaggatcccggtggcgaaaccaaccatggcattaccatcgccgtagcccgagacttcgggtacaccggtcccatgcgtgacctctccaaggagacggccaccaacatctacgtcaccaactacatcaacaagccgggctacggtgagatcatcacgctctctccggcagtcggtcagaagatcgtggatgctggggtgaacaccggcacctcccgttcttcccgttggttccagcaaagcctcaactccctgtcgcgtggcggggtcgatttccctcaaattaatgtcgatggtaagatcggccccggatccattgcagcgtaccggtcgcttcaatcggtgcgtggaaaagtcaaagcctgtgagctggtcctcaaactgatggatgctcaacaggccagtcactacatgagcctgaccaagaccccacagtatgtgccgggctgggttgaccaccgggtaggcaacgtcccattggagaagtgcaaggaatgaacctgaccaacatcttctacgctggtgtcttcgctgctgccattgctggctcctatgccctgactttcaagtacgggcattttgtaggcagcatggaggtgttgaccgagtggaacgaggcgaatgttgagcgtgcaaaagcagatgccgagttccaaaaagaaaatgctgccttgatggcagcacatatcactaaacagaaagagctggaggaacaacttgatgagcaaggtcttcacttcgaaagcatgctcgatgctgctcgcagcgactttgctagccggttgcagctcgcagaaggccgagcgggagtatatcaacgacaagcccaaggcagccgtgctgagcaaatccgccttgcagagcatgcagccgaactcgaccgatctcttgaacagggccgggctctggtacgagaactcggggaaactgttagacagcgtgaccgaaccatcggcatcctccgagaagtaatcatcaacgaccgcaccctcactggtgaacagtaatgagccttgaccttgaacaacgagtggatggcaacgagttgccgaagctcactgactgggtgaatgaacccagtctgcgtgacttgaagttggacttcgagaacgcccaacagaaccactcgaaccagatggccaagatcgacaagtgggtcgagctgatgaaggtcaccggtgcgagcaagcctcagaaagtcaaaggccgttctggcgtgcagcccaagctgatccagcgtcaggccgagtggcgatactctgccctgagtgagcctttccttggttccaacaagatcgccaaggtgaccccggttaccttcgaagacaccgatgctgcaaagcagaacgagctgctgctgaactggcagttccgtaccaagctcaaccgggtcaagctgatcgacgacttcgtgcgtactgtcgtggatgagggtacttgcatcttgcgtactggctggcgtcggcacatggtcactgtggaggtggaacaaccagtctacgcacattacgagatccagaccgaagagcaacttcaggccttccaacaggcctacgagctgtctgaggaaaaccctcgtggattcgatgaggacgtggacccagcactgaaagaggcagtcacctacttcaaggagacaggcattgccacttatgcagtgcaggttggtactcaaatggtgccaacccagaaggctctggagaacaagccattggtggacatcctcaacccacgtaacgtggtgtttgacccgtcctgccaaggtgatgtcgaaaaggccaacttcgctgtcgtctcgttcgaaacgaacaaggctgagctgctgaaggaagggcagcgttacaagaacctcgactacgtgaactgggaaggcaacaccccggtcactgccaacgactacgcaaccactaccccggattccttcaacttcaaggattcgatgcggaagaaggtcgtggcctacgagtactggggtttctacgatgtgaacaacgatggccgtctggttccgttcgttgccacttggatcgggaacgtcctgatccgcatggagttgaacccgtaccctgacgagaagctgccgttcgttgtggtcacctaccgtccggtcaaacgtgatctgtacggtgagccggatgctgaactgctggaagaccaacagaacattctcggtgccgtgacccgttcgatgattgacctcttgggtcggtcggccaacggtcagcaaggctttgccaagggcatgctcgatcccctgaaccgtcgtcgttacgataacggacaagactacgagttcaacccgaaccagaaccctgccaacaacctcatcgagcacaaggctcccgagctgccacagtcggccttgaccatgatgaccatgcagaacaacgaagctgaatccctcactggggtgaaagcattcgctggtggtgtgtcgggtgaggcctacggtgatgtggctgctggtatccgtggtgctctggatgctgcatccaagcgtgagatggcgatccttcgtcgtctggccaaaggcatggctgatgtcttcaacaagatcattgccatgaacgcagtcttcctcagtgaagaagaagtcgtccgtgtcaccaataaagagttcgtcactgtcaaacgtgaagacctccaaggcaacttcgaccttgaagtggatatctccactgctgaggtggataaccagaagtcgcaagatctggccttcatgctccagaccattggcccgaacggcgatccgaagatggtgctgctcattctggccgagattgctgacctcaagcgtatgcctgagttggctcagatgctccgtacctacgagcctcagcctaccccggaacagcagatgctccagcagttggagatcgagaacaagcaactcgaaaacgagaagctcaagtccgagatcgcactgaaccaagcacgagcacaacgtgagctggctatgaaagaacaggctgacctcgactacgttgagcaagaaaccggtactgcacacgagcgtgagatggacaaacaacgtgcccagtcgcagggtaaccagaacctgcaagtaactaaggcactgactactccacagaaggaaggtgagaagcagcctgacctgaatgctgctatcggattcaacgctattagttctaagttgaacgacgaacagccttcgagtactattcaacggaatgactctggcagccgacctaccaatttggggagcagccagttcaatccagccgtagatccggcactcaacccagccattggcatttaattcaaggaccaatcagacatgtctgaagtcgaacagaatatcgaagaactccaccagtacaaacgtgagcaacagactctggtcgatgctcgtgatcaggccattcgcctgagcaccaacccggacttcaagaagctgattctcgaaggcttctgtaccagtgaagccgcacgttatgcacaggagtcgggcgatccccagctgactgccgtccagcgtcaggatgccctgaacatggcacaggcttcgggccacctgaagcgtttcctttcgatgatcgtcgtcatgggcaacactgctgcccgtaacatccagcaagcggatgacgagatcgcccatgtcacggagggtggtgagtaatggacaagtccactgacattctcgaaatgtcggacgaggacttcgccaagctggcccctccagcagtaacggaggctccggcctccgaacctgctccggccactgaagaacagcaagcagctccggctgctgctgctgctgctgtcgaagctcctgtccagaccgaagaacaacagcctgctgctgctactgaagaagagcagcagactgaagagcaacagcaacaggccgaagaacagcaacaagctgctccggtcgtcgaaggcgaacagcaacctgctgccaagcctgatgctgctgagcaacaaccggctgccgaagagttcgactacaaggctgcctacgagaacctgctggccaagccgctcaaagcgaatggcaaagagatcaagctcaactctatcgatgagctggtccagttggctcaacagggtgctaactacacccgcaagatgcaggaactcgcccctcaccgtaagactctcctgatgctggagaacaacggtgtcgatgctgaaaagttggacttcctgatcgccctgtcgaagaaagacccggcagcgatccagaagtacctgaaagactccggcgtcaatcctttggatattgatgtcgaagctgaggcgacctaccaaggtggcaatcaccgggtcagtgacgaagaggctgctttcgccaacacgctcgaagacatgcaaatgtctgaggctggcaagtatgtcctccagtcgattcacggcacgtgggatcaggccagtaaggaactgctcgtcacccaacccaacatcatggagatcatgcgtcagcaacacgaggccggtttctacgaccgtatcgcggctgaggtggatcgccagcgtatgctgggtgcaattcctgccagtcaaagctggctgcaaagctacaagctcatcggcgacaagatggttgagcaaggtttgtttgcagatttgcttgcaaaacaagagcctgctgctcaaactccccctgtcgcagctgctcctgtggccacccgtgtagctgcaccaaagccgactgtcactgctgatgctcgtgctgcggctgctgctccaactcgtgctgcaccgtctgctgctaagaagctcgtaaatccgctcgccatgagcgacgacgagttcatgaagcaattcgaaaaccgtctctaagtaagggaagccccagatgctgaactataacgctccatcggaaggccaacagtcttccatcgaaggtgctggctccagccagatgaacaccttcttctggctgaagaaagcgatcatcgaagctcgcaaagatcagtacttcatgccgctgtcgtccaccctcgacctgccgaagcactacggcaaggaagttcgcgtctaccagtggatcccactgctcgacgaccgtaacgtcaacgaccagggcatcgatgccaacggtgtcaccatcgtcaacggtaacctgtacggttccagccgtgacgtgggcaccatcgtcagcaagctgcctgctctgaccgagaacggtggccgggtcaaccgtgtcggcttcacccgtctgcaacggaaaggctcgatccaccagttcggtgtgttctacgagttcaccaaagagtcgatggacttcgactccgaggacaacgtgaaagagcacctgagccgtgagctgatgaacggtgccgtccagctgaccgaagcggtccttcagaaagacctgctggctgctgccggtactgtcctgttcgccggtgctgccacctccgatgccaccatcactggtgaagtcaccccagaagttccgggcacttcccctgaaatcccggcctcggttgtcagctacaagaacctgatgcgtctggacaagatcctgaccgacaaccgtaccccgaagcagaccaagatcatctcgggttcccgcaacatcgacacccgtgtcatctccggtggccgtgtcatgttcgtcagctccgagctggcctccaccctgaagggcatgaaagacctgttcggcaacaaggccttcatcgagccgcagcactacgccgatgctggtactctgctgaacggcgagatcggttcggtcgatgccttccgcttcatccaagtgcccgaaatgctgcactgggctggtgctggtgccccggtcaccgataaccccggctaccactcgaccaacgtcggtggcaccgagcgttacgacgtgttcccgatgctggtagtcggcgacgactccttccagaccatcggcttccagaccgacggcaaaaccgtcaagttctccgtcatcaccaagatgccgggcaacgaaaccgctgaccgcaacgacccttacggtctgaccggcttcagctccatccgctggtactacggtatcctcgtcaagcgtcctgagcgtatcgctctgatcaagaccgtggccccgatctaatcgaccacaccactgaccgagggggagtgttccccctctggttccaacactccttaccggaactgaaaccatgagcgtagttaccaaccctctcgacaataacgaagacgacctgaagatgccttccgaactggaagtgctgaaggaacgtgccaagctgctgggcatcacccacagcaacaacatcaccgtcgaaacccttcgcaagaagatcgaagaaaaactggccggtgagccggaacagcctgctactccagtggctcccctgaccgcacctgtcagcgaagaagctgctgccgagatggcagccaatgcttccgaggccttggcccaagccgaagcaccggctccgaccaagacccctaccctgcgtaattacctgctggccgaggccaccaagctgatccgtatccgcatcaactgcatggatccgaagaagcaagacctgcccggtgaattcttcaccgtggccaacgaacacatcggcaccgtgcgtaagtacgtgccttttggcgagcagaccgatggtggctaccatgtcccggcctgcattctggacatgctgcgtacccgtgagttcctgtcgatcaccaccaccactcacccggtgaccaaggcgatcactaccaagactcgctacgtcaaggagttcgccatcgaggttctgcctccactgaccccggctgaactcaagcagctggctgctgaccaatcggcctcgggccgtttggaagaccgcgactaaaacttagctcgcatacggaaggcccggctatggtttaatagtcgggcctttttcatttgaaccaagaggaaaccctatgagctgcggagctgataacgttgccaatggcctgatcacctctctgcttgcgggtgagtcgttcgacatcccgactgtggacttcaccaagccggagttccagttcccgtatgacccggacagcccactctacatgcagatcactccggtcacgctgtcggacctgactacccgtacaccgggtggggatggtgcgttcgatgcactgatggatgctttccgtctccacctccgtgaggaaatggagaagggccgtatcactggtgccgagtacaccaaggcgtacactgccctcgctgacgctgccatgaaccaagcggctgcattcttgctcggcaaggatcagtccttctggcaggcacagtcggcacagattcaggcaatgactgctcgaatcgacatggagactgccaaggtacgactggcatccatgcagctggaggcccagaccaacaaggcccagttcgcctcgaccaagatggacttggccaccaaggacgttgagtactgcattgcccagtacaacctgtctgccatcatgccagcccaactggtcactgctgagctgcaacaagctggtgctcgcattgccaacgacactgccacctacaacttgaacaccatgatgccgttgaaccgggacatgctgaccaagcaggtggatggtcagaacatccagaacaacacggcttccttcaatctgtcggacatgatcccgcagcaactgaagaaccttcaggctcaagagcgtctgctcaaggagcagatggaagcccagcgtggccagacctcggatgtccgtaccgacaacttcccgattgccggtgttcaaggcaagcagaaagagctgtatgcacagcaggtcatcagctaccagcgtgatgctgaagtgaaggctgccaagatcttctcggatgcttggatcactcagaagaccatcgacgagggtctgctggctccgactgcgtttgccaacgcttcggtcaacgaagtgctctacaacatcaaatcgaagaacggcctggggacggtctaatgggctggtttagcaagaagaaaaagatctacgtctcttccgtcacctacaaccttgcaggtgatgagaaggatcatgttcgttatgtgccaactacggtgctctccaagatcatctcgaacagccagttcgatatgggtgagacgctccgtggttccttgattcgtgggccgggtatgcgtatgcgtacctttggcaaatgggctcgggatactggctattcttctgctatcagccttcagactggccgtcttcgtggttccgctgctatcgatacgggtgtgctcgctagcaccattgagcacgcccctgatcaagaggtgctggtggattatgccgaggtggccatggctgactacagttattgggctgagcaatggatggctgagaaccacccggcagaaatgatggaggacttcgaactggatttcaaagaagacatcaacaccatctttatcaccttccctgatggacgtggctacggcttccagcctgtgaactttgatccgttgtcccagtacctgtttgcggcctacaccctagtgtccaccccagagccgtccgaccctgagtgggaggcacctgttgtggtcgctggttccggtgacttccctccaaccatgggctggacggtggagagcaacacctccactactggtgtcatgaacgtgaacaccaccgtcactgctatctctactttcagtgatggccgtcctgctcagacggtgaccacggttacgccgggcactgccgggtacacgaaccaagaggtcacctactcgcaggagtactacgacggttcaggaactgagggcgaggatgagttggtcaatatcaagacccttcagcagaacatgcggaatgctgtggttgtttcgtcgtcctcgtctgacacctccactgaaaccattgggggtggtgtaatcaagaccacggttacgactacgactgttgagacgctgaccgatgagttcagctaccgggaaggtactcagcgtgtggtaactaaacgctggtctgcccgtaagaccttgatctacaagtacaacactggccgtcctgagtacgacgccatgtttggtgccaccagagacactggtgtgtatttcccctttctgcccattcgtcagaacgagcagatgatcagtcctacctactatgactctatctacgatctgaacctcaaggcttacccaaaggcttttggtaggaatgccaagtacacagaactcattgacaatttgaacagtaacagctcgattggtgacgtagaccacgggttcgttatcttcggtgtggccgtcaacaccaaaaacacttcggcactgaaatacatctacaagtactttcaggccctactggctcagggaggaggaggtactggctacgacgcatggaaggctctatggaacttggccgatatccgggccagggcttgggtgagttggcgtgaagcccagtcggatccaaacagtcctctgtttggagctgatgagccaccaaagggtgtttacccagcagccccgatcacctcggtccaagtctactcggatgtcttcaactacaacatgatcgtctcgtggagttcgatgaccgaggtgaccggggttggattgggtaggcccggtgccaaggtgggggatgtctggtggaccattggtgccagtgagactttcaacgagatcgtttactccggtggggtagctggtgtggccccatcctcctacagcaccgtgctgctcacttggcaggatggggtgaacacattccgtactatccgcaccactggtctgcaccataccaacatcgtctacaagggcaagggcgtggaccacagtatcagtgcgtccattcaggaaggtgacgtaaccggcttcgtgatccctctgcatgaaggcgtctttcgtgccatgtcccttgtggatcagacggagatgagccagtccaatgcctacttggttctcaacagctacgaggttgtgaagcagaagtggtatcagactggcttgttcaaagtgatcctcgtgatcgtcatcattgtcatcagcatctttacctacggtgcaggtgctggggtcggtgcaggtctgctgggtacagcagcatccgtaggtgctgcccttggattcaccgggatgatggccattatcgttggttctattgccaacgctttggctgcaatgattttgtcccagatcatcatgatgggtgccaccgccctgttcggtgacaagatcggtgccatcatcggtacgattgcctctattgtggcagtctcctacgggactagcatggcctctggacaaggcactgctggggcactcaacaacctgatgtccgctgagaatgttctgaagctcacagtcgctgccggtgaaggcattgcgtcgttcatcaacgacgacactgctgacatcatgaagcagacccaagaggtgatcgacgactacaaccgggagatgggctacatcaacgatgagtggtacaagaacctcggctacgggaacatcctgttcgacccaatgcagctgactgacattggcaagcaggacttctaccctgaaggtcgagatatgttcctgagccgcacattgctcactggttccgagatcgctgagattacgaactctctcctgtccaactacaccagtgttagtattagcactgaactaccaatgtaacggaggcctcatggctaatgtccaacaacaaagccagttcggtgtgctcgaccaactgggtgcaatgctcggcttgggggatgatggcattcgggaaactatgaccattcccactgccctgaacaccagcagtaactggtcccctccgggctcgatctctaccccggtcaccactgctggagcaggtggtggtctgggcaccggccttggcttcaatgtcggcacgggccaactggcactgggtgggctgtctgctctggctggtatctggggtgctatgcagtccaacaagctggcgaaggagcagttcaaattccagaaggagttcgctaataccaacttgaacaatcagatcaagtcgtacaacacggctctggaagatcggctgaatgctcgtggtgttatggagggtcgtgatcctgcctatactgctgctgaaatcgaccgtcgtcgcctgagccggtaaggagaacccaccatggctgcattgacttggcgagacgttgctgttcctagctttgctggggtcaacgaatcgtatcgtactgctggtgctcagatgcaacaggcccttgcgggtctggctgacgggctcaagcagttccaagcccagcgtcaagctggtatcgacgctggcatcctcggtcgggccatgcagatccaagaccctgctcagatgcgagaggctttggcttctggctccctgttgcagggtgtggacctgtccaaggtcaatccgaagattctggctcagttggatgagcgtaccggtgccctgctccgtaacgctgccactgaacagaacatcgccagctccaaactgggtgacaagcgtacccaacagaccatcgatcagtctgactacaagcacaatcgtaccgtgcaggaggacaccaacgaggatgctgctcgtggtcaactggctcagcagttgggtttgactggcccattggcaaatctgtccaccaaggatcagcagaatgttgcttcgacccaatcgactctggctacccagcgtctgggccgggctgctactgcactgggcatggaccagacccgacagaacatgagccagtcggccaccaacttcaacaacgctcagatcgaccggaatgagcaacgtgaggcactgaccacggctgacaacatcacccgacagtcggctagtgtggaagacgctcgtgcgaatctggatgacatgactgatcagtccccagtggttcgtgctcgtgtgaatgccctgctggccaataccttcggcaacctgtatgcacctattgacggtgcaactactggtggcaaagctggtgttggttcgggtgccccatctgatgggactgctaccccttcggctcaagctgctgaagctctggccttgaatgctcgccgtgtggcacagaacagttctccgggtgtagtggctgacatcgagcggaccatcggtgatacccgtagtgttggagaggtcgcccaagagattgccaagctgatccctgaagctgatattggcaagatcattggccgactggccaaagccaagtcggacaaccccgacctgtctgctgctgaggtgggtgctgcaatgacccgctctctgcgtgatgcaggcttcttcactccggggaccacttcgctgggtgagggtgcaggctacgacgacggggcgttcactgccaacctgaaggatcttcgtagtggtaaggctgactaccaatcggctggtaatcgccaggtgcgtgcagtgggcactgcgatcaagaatgctgacgctgccttgaccaaagccaagcaggaactgctacaggtccagcgtcgtgcccaaacccagtcgggtgtagacaccagtcgctatcaagagcgtgtggatcgtgcccaacagaagctgaacgatgccatcgagaagcagacgagcaacccggacttcatgcctaacgtgctggaagtggttccggtgccagtgcctcgacaggctgttcatcctttcccactcgggtaacataagaagccccagcagaaatgctggggctttttgattttacatggtaaagtcttcctcaaacttatccttagataggaccgttcatggctaacccactcgacctgcttgcacaagcagctcaaggcgtccagatgatgccggaagagcctcagttcccgaatctccgcaatgacatccccggtgacttcagtcaaccggctactattgctcgggccaatacccctgcacctgtccatgacgagcttgttcctcagcaacaggcacaggcagtcaattgggcagccgaggctgcacaaaggactcctgttcggagcaagatgatctctctggatcgtatcagccagtccaagcaatcgtccgttgctcaggcagctgctgccaagcaatcgttcatggctccacaggattactttctgaacgctgtaggtgcagacactgacaaaggccgtgacactgccactgaggtagaacgtgacctgcgtgacctgaaccctctccagatcctccagaagtatggtgacgaagaaggttcccggttgatcgccggtcaagctcgtggctatggccagttgacccaagcggacactgcccttgcccgtaacaagaccgagctacaggatgacctgattatcaacttcggccaaggtgttggtggtgctctgggtgggttgggtgctttcggtctgggcctcatcagcgatactgctggtacttacgctgccgagaaagttggtcagttcaacaagttcatggaagggatccagtcgcctcgccttcaagcacgtcaaggtgtgaagcaagccaaagacgcactggatagccgcgactctgctgcccaagccgtcaaggatgctgctgagtatggtgatgctgttgctggcctgaagcgtattggtcgtgacgttctgtcgtccctgtccaacgcaactgacgaccctgccactctgggtgctggtatcacccaggcagctggctcgttcgtggctgctggtcctgtggctaaaggcctgtctgccctatcagggggtgcgctcggcaccactacggctatcgctgccactgaagctggtggtgcatacactcaatcggctgaccagatcatgagccgtacccatgagcagctgatggaaggctctcagtactaccgtaccctgatcgagcaaggcgcctcgcaggaagatgccaagcgtgctactgctaacagtgtcggtctgactgctgctgctattactgccccggttgcggctgctgccggtcgtctggtgcatcgttttgaaggcaatgtcggagcccttggttccggtcgtcagttggctgacaacgtcattcgtgaaaccgcagaagagtccatccagtccggctttagccagttcgctcagaacgtggcaacccaacagatcgcagacgacaagcaggctctgaccgaaggcgtcggccaacagatcgctgaaggtggtctgtacggcatgggtatgactgctgcactgggtgctccatccgtagctcgtgatgctgctgcggctggtggccgggctgtggcttctgccttcaatgaccgtctggctcgtatcgacgaagccaacaaagcgtcctcgcctgtgtccgacgaaactgtcgctcaggctgctgccgaggctcaagcgtctgctcctgttgctgagcaagtcctgcgtgaagccgttgcttctgctcctgctgaacagcaagaagctggcaatgcctacgtggaccagttgctggctgcatctcagttcagccctgacgaagcccctgctgctttcaacggtctgttcgatgacgtgaccactcgcaccggtgcgatccagcgtatggctgagatcgtgaactcggctgaggaaggttcgaacgaccagctgcgtgctggcttcgctctgtacgatttggtcaacgattacgctgctgccatcaaccaagatcctgacgctctgtcggctctgcctgctgataaccaagcagcacagatcgtggctcagtaccaaggcctgatgggtgctatccagaactccccgaaggttgctggtgcaatcgacaaggtgatgtccctgctcgaagcctccgaggccaagcaggttgacgtgactgctgaatcggtgaccacgcctgaaggccagcaggaagtagcggacgtgctgtccactgctgaactggcccctgagaaagttgatttgggtactgctgagaagatcctgttccagattcagcaaggcaacctgacggtcactccacgtcaaaaggctgccttggattcgtctgtggcgatcctacgtgcggtgcaggaagctgacaaagcggcgatagcagctggtcaggcggacccagtgagcctcaatatcagcacggtagacggtgagaaagggaagtcgctgacacaacatgccaagggcatcatgtcggcgtggaaggcgggtgaccgtgatctcgcagctgaccgacttgtcgatttgaagaacttcgctcaaggcatgagcaataaggtcggggctctgaatgcccactttgctgcgggcaagccgaatgctgagggactgcactacgaggtgttcgttggtggagaggctgtgccctccaaagccaaagtggctacccgtactggtagccaaggtggcatccagtttgctcagaaagtcgctcgtgaggcgaaacttctggctgatgtttacaacggtcttgcgaccgcattcccagatcttggagctgaacatttggcggtaaccccgctggcaagtgaattggtcggcaagcctgctgaggttgtagcacgtctcaaacctcaagctgccccggtcgttgaggtgaaggataccccagctccacaagctgcacccgctcctaaaaaagaatctgccccagctgcgaaacccaccgcatctgtggttgagaaaaagcaggcacctgttcaaaaagtagctgaacgtgtagtggaagaagcaccagttgtcgccgaaccggctccagcactgaagggaactgctgctgcattccctcaactgatcggtggcgagtccaactacttcaaccgctcgttcaagctgcccaaggaacagcgtactcgcaccatgggtactgaggcacccgtggccactgtccgtgctgcactcaaggactctgcttccctgactgctgccattggttccttcaagggcaaatacacccctgagatcgccaaggcctacgacagctaccttgccgtggctgaagacttcgtttccgaactggatgacactcttcagcaatatctcgattctccgtacagcaaatccaacccgaccactattcgggagatcgttgacggtgccgaggttcgcacgggccaaggtgagctgttcgagcctgctcgttctctgcaaggccgtgttctctccattgcggagcgagatggcaatgacgtggtgtacaaccccgagttggcccaatcggcagtgctcgccgggttgcagtggttcctgaccagtgacaactacgccagtgagcaagacaccacggacatcgccaagctgcttggcatggaagaggcgtctgtctccgacgagatcgtacaggccctgaaccaagggctcagtgtgaccgaggccaagcgttcgcttgccacgaagatccgccagtactggggcgtccagaacgaagccgatgccggtatcggttatcaggaaggtattccagaagcggttgcagccgaagtgctgcgtgcattcgtgaagggtggctggctgactgaagagacggtggagctgaccgaagctgatggtctgcctgctctccctgacggcaagccgaacgtgaagacctttatccagttggtcccttccgagatcccagctgactccccgctgcgtgcattcccttcggcaatcgaacaggctgtcctgatcgaaccgcaggagatgaacttcatcggtgaaggcagtctgcctccggtagctaaggatcagttgcgtaaccccggtgtgaagaacactgcccagcaactcgccatgatcgagaaagagcaggcaactccttacaacgtgaacacgcacatggctggtttctacactgcccttggccgggacaatgtgctctcgctgttcggtgctggtgaggttgatccgaagaccaccaacgtgaaccacgctcaatccatggaaggtgtgaaccgttccgtggtggctgcgttcgaccacctgcaaagcctgctggctgaggtggacaatatcggtgacctcgctaccacccctatccactaccagttcaacatgactcgggttgctcgtctccagatgctgggcaagtacaaccctcagtccaacaagctggtacgtgaggcgatcctcccaaccttcgccaccgtggacctgtccagccaaactggtcaggactacaagcggttcatgctggctgtcggccagatgctgggcgtgaaggtccacaagatgtcccagtcccgcagccgtgctgcaactgaggccatgctgactggtcctctggctccagcggttgaggctctcgccaatttctccaagggcttccgtgacagcgacgtgctggcaccttctgccacgttggacaatgccaccgtcgagatcttgaaggatgccttcaaggcctctggcgaagcactgaccccgatggcactgcatgctgtcatggactacgcccgttacctgaatgctgaggacaagtcggcgttccgtactgctgtgtacgtcgaagctgacggtgtgaccaacggcccgatcaacgcaatggtgctgttcaccactggcctgttcaaaggtaactggatcaagaacatcgccaagggtggtctgttcttcaaccgtccgggcgaaactgtgaataccaacaacgagtcgggtgattcccgtgacctgtaccaggccactactgactcgctggatggcaagctgaacaacctgcgtaaagtcctgcgtgacgatgccaagggcacccagcaaatggacgccatgctgcgtctgatggatctgttctacggcaaagacctgaccttccgtgaggaagagggacaggacgccaagctggaattggcccgtggtatcgccaagaacccgctgacgatcaccatctacggctccggtgcaggcggtatcgctgccaagatgaccaagatgctgaccgatgctatgtacgagcgcatgagccaagtggcccaagcacgtgctaatggcgagacttcgattgctctggccatgttcggccctcagtcggtgagcgtcgaggatgccaatgccaagtacgagcggtttgtggactccttcaccaagctggtgaacacccaagctggtgtgggtaaagacggttcgctgttcttcaagagcaacccttccaaggatccgaagaagtccttcgaccctgtgaagttcaccctgactgcccacgacatcggcaacatccagtccaacgtccgttacctgttcgttgacccgatgcgtgatgctattcgtgacaccgtgggtggtgagctgctggatactgccgagatgctgcgtatggcaactcaggcccagtccattgttctggagcatgccttcaaggctgaagttgacgccctgctggcacagaaggccgaagacccaagctggaagaagaccgacttcctgactcgtcgtgagctggatggcatccgcaagaagctggagcatctgagcccactggttcagaccgagcaccagaacttcttcatcgccggtagcgagactgctgacgttgaggcgtcccagttcggtcgctctctggacggtcgcttccgttccccggctttcgtggctggcccaactgacgctggcgtgtcgggcatcccgttcctgaacatcggttccggtgatggccagatgatgcaaaacatcagcgtggctcctaatgcaccgaccggcaccctcaagatcttcgacggtatgaacatgccgttggatcagatcgagtccggttccgaggtggcaaacaaggccgtgatggactcgtggatgggcaaccctctggctgccgttcacaagtcgttcagccagttcgtgtctgacgccaagctgactgacctgagcaaggaagcccgtgaggctctgtccgaagctctgtttggtctgggtgacaagtcccacaccgagaacgagatcgtggacgctatgacctcgctggtgagcaaccttgacactgctcagcagttcatcgaagcccgtcaccgggtgatgagccgtgtttctgtgtcggtagaccagatggctgctgtgggcatgccgtacacccaaaacggcgacctgccattggctggtactgatcctgactctatcgctgagcaactgaacgtctacctgatggcagagctggcttcgatgcagggtgacaagccgtcgcacaccatgtcggctgacatcgctggcgtggcacaagcacacgagactggcgtgtcgatcatgaccggtgctgacctgccccagctgaagaccatcttcactgctgagcagaaagccgtgctggatgtggttgtcgattcgctggcagctcaggactacaccattgtcttcggcaatgctcagcagatcgctgactaccaagcagaccgtggcctgccgggtgcaactgcatcgcctactggtgaagtcttcggctacaccaaccccggcgacaagacgatctacctgatcagtccaaccactgaaaccttcatgcacgagctggtacacgctgccaccttcgaggccgtgaatgctcactatgctggtgtcaccaccaagccagtggcagatgcagttggtcgtctggaaaccatgatggaagacttcctcgcctcgggtgctgagctgactcagacctcccagtcggtgaactctgccttcaacaacgtctcggctgctatccaaggccacctgtcggctggccgtcctgccgaggctctgaacgagttcatggcgtggaccctgaccaatgaatccttggttcgcgtagctcagcgtcagcaggtttccaagctggctcgtatcaagaacaaggtggtttcggccatcaagtcgctgctgggcatcaaggaatcggctggtcgtgacctgttcagcaacttgctgttcaacagttccatcatcgcccactcccagcctcagctggctgagcggtttgctgctggttccctgttcatgaacagcaactacggtgctgaccagcgtctggcagatgtgaacgacaccttcaacaaggcaatcggtcgctacctgcaagaagccccaactgcccggaacatcgaccagcagtcggccttcatgaccggcatccagaatgcctaccgtgtggctgagtcgttcatgaataacggcttcaacatgactgcccaagaggccaccacgttcaacaccatcgtcactgcactgagcactgaggccacgcttgatccgaatagcatggctgccgttcagcagctgtactcgcatgtgatgaagcaactgtcgcctgagtcgttcatggctgacccgaacagcactcagccgggcgtctatgagactgcggccaagaagttcgatgtgctgtccggcaaattccttgtcacccgtgacctcgctggccgttccagcctgctgccagctttcttggcactggccactaccaacaacgagttccgctcggtgctggagaaactggaactgccgaagactgctgccaacaaggcgggcactctggacgctctgctggagaacatgggcaacagcatgatggaccgactgggccagcgtatgactggaaccaacaaggccaagaatgttcaggaggccattgacctgctgaacgctcacatggccaaggtcatcaacgaccgtgagacgctgatcgaccagtccttctccaaggctggtggcgtcatcgaccgtgcaaatgatctggtaaccagtggtatggagcgtctgactgggcaagctatgaagttcgccaagcgtactcaacgcaatgcagctggccgtctggaacgtactgccggtggcatcgtggctggctttgctgccctgatcaacgagcaaactgccaagggcgtttctcagtccactatggctgccatcaacaagaccaagctgtgggattcggttcacaccctgatcaacgatgtggtcggtcgcaccgacagcaatgcttcggtttacgacatgatcaaagcagttcgctccgtggttcagcgtactcgccagcaataccgggagaacctgcctgagctgctggcttcgaagttcagccgtgagctgaccaaagaagaaaaggccagcctgcaccgttcgatggcgaagactgaccttgctgctctgggcaaagacgcactgcaactggctgtcaacccggaagctgctatcccagctctggaacagggtctgtctgccaagcacattgagaaggccaagcaactggccaactacatgctgactggtgtaccgggcaagaacctgctccgtaacccggaagctgtggcccgtctgctgggcgaaggtcagaaagtctcggctctgcctgacgtaggcaagttggaccggctgatcactctgtacgccctgcgtggtctggaccaagcggacaaggatatccttgcttccttggctcaagacgaagccactggcatgcagttctcgctggactacctgactggccaacgtgctgaggaaaaacggaaggccactggccgtgccaagttcaactacttcaagggctacgtgcctgagatccgtaacgaaggcgtgtccatgctggttgcccacgacagtgagcacgccaagttgctggccaagtcgtacacccgtgtgggtgactacaacggttcgcctctggaacgtggactgaagcgcagctacttcttcatcccggtttctgcccgtgccactttcgagcaaggcatcatgcagaacgttcagcagaccgctggcggtgtggatgcctctaccggcttcaccctggcccagactgctggccgtatcaccgatgctgctgacgtgaagcaactggctcgccgcatgcctcgtgatggtggccgtgaggctctgctgccggtctacaacgaagctggtgacgtggttgccttcgagcgtgctttggacagtgacgtgatgtcccgactgctggctgaccaagaccttcacaagtccatcggccaatggcgtggtcgccaagttgaggaaggctacagccaagtcttcaacgaggctctgatcggtcgcctcaaggacatgtacgaccgggatctggctgaaaacccagacaatgcccgtcagtacgtggacctgctgagcaccactgatccagtgtggaaggatgctgtcagcttgatgaaccatgagactcgtgctctggtcgagggcgccttcggtgacaagttcatggtacgccgtgacatgatcaccgatgctgtcggctatcgtgctgcctcggttggcgatgtttggactggtaacacccgctggagcgagggcacccgtaaggctgttcgtaacgtcgccactgctgtattcggcaacgacgcctacaaagccctgctgactgccgagaaaaccattcagtcggttgtggcagatgccaagaccttgatcgtggtcaagtcggtcatcgttccgatgagcaacctgatgtccaacgtctaccagctgattgcccgtggtgtgccaatccgtaacacgctgaaggcattcccggctaaggctgctgaagttgaggcctacaccaagtctctggtccgtcgcatcgaagcagaagccgagttgcgtgcggctggtggtgatcctcgtgttgagcgtcggctgaaaaccgagatccaagcgatcaacgacagccaccgtcgcatgagcatctggcctctgatcgaagccggtgagttcagcggtattgctgatgccgggatcacccgtggtgagatcccactgacctcgggtcgcctgcaagcctacatggaacaggccgcatcgaagctgccgggctggggctcgaccattggccgttacgctctggtcaccaaggatactgctctgttccaaggcctccagaaggcagtggaatacggcgacttcttggccaaggctgcctactacgacgacctgacccaacggaaaggcctgactcagaaggaagctctggctctggtgactgaagagttcgtgaactacgaccgactggctggccgcttccgtggcaccatggaaaacctcggtctgctgtggttctacaacttcaagatccggtcggtgaaagtagctgcgtcgatgatccgcaacaacccagtgcatgcactgctggcaggcatggccccggcaccggagttcttcggtactgtcggtctgccgattgaggacaacatgatcaccaagatgtttgacggcactctcgactactcgatgggaccgggccaaggtctgcggtcgatgatgttgaacccttggatcaatctgacgcagtaaaaggtgttgacggacgccaaggttatctctaatcttggctccgttgttgggggttcgccaagttggttaaggcacgggattttgattcctgcacgcgaaggttcgaatccttcaccccctgccactttttggtgagtagcaaagtggtaatgcaccggactgttaatccggggatcatgggttcgaatcctatctcaccagccacggtgtcttagctcagatggttagagcgctcccttgtcacgggagaggtcacgggttcgaaacccgtagataccgccactttttcgggtgtgtatgcaagcggtcgaagcaaaccggctgtaacccggcacattgatacaccttaggttcgaatcctaacgcacccaccaaataaaaaagcccccttcttcaagggggctttttcttgtccgacgggtagtcgatcagccagagaaagccaagaaccaagcaggccactatcgcaattgcgattggtagggcggcagcgtggatggcactggcaacacaagccaccagcaccaacaggccgagccctactaagagggctcggaacatggcttagttctgctggttgttcggcttgcggaggttggcgaacagcgactgggtacgcggacgctcttcagcggcaggctcattcttgaccacttccggctcagggtcagcagcaggctccggctcttcagccggttgctcttctacagccacgggagattcagcgggttggggatccaccggagtttcaggctcttcagcctgttcaactacgccaccagcagccgaactcgatgcagcttccgaaggttgagcatcgggagcagagttggtctgggtggaggcctgctgttggtttcccacagcagcgtcctcgaccaccggtttggtttcaaccggagccgattcggctttctggcgacgctggcgaggcttacgttgcggcttgccagccggggccggagcatcttcaatgcccacgccttcgttcacgaagacagcaatggtgccgtcctcttggaactcgacgtggaagttgttggagtcgtccagacccagctgggcttgaacatagcccagtaccacgtcggagacttcagattggttcagggtgatttgcattacgaagttaccttcttccacagggtcatgagttgctggaactcgggggtgagtactccagcatggattgcaccgatggcatcagcccggtgctcgcagttgttcgtgggcttgcctcgatgccacgtccacccggcatccgggtagaggtccatcgcagcagcgatcatgtcagccttgctggcattcgggttaccggccagggcctttttaacagccttggcttgcacctcgatgacgatgatccccttggctcgcatggcaccgacgataccgtgggcaacacccacagacttcatcgcattggccgactgggaaccaacaggacactcggagaacacgaccttcacacgctccccaacaaggaaagcgtgtgaggccagctcttcagtccggcgtagatcgtccgagttggttcggacttgtttgtccttccccttctcggtcgattgcagctcagtcttcacgtcggtgagtattccggtgttcaggcaaagctggccttcagcggtcccccagttcgtgaaactggggtccattccggcaaccgggatgatcacttacttactgaacagcgacttgcggccaccagccggggcagcaccaccagtaggcggtttgccagcaggctttccggcacccggagcagcacctttacgcttgtcgtaaggcttgtccttgttacgttccagccagctgtcccagaaggacgattcctgaccggcacgagcctcggccatggtgaccttcgactcagtgtggaagaccttggcgatctggttcagctcgcgggtttcgccagtcggctcgtactcgccggtctggtcgttcttcttggtcttgtcttccagcacgtgctggatgcccagcgacacttccttgtcgcagagatcgacggcgaccatgaccttggtcgggacttccttcttctggtcgtagtcgtagatcttcagggtcttctcttcgaagacctgttcggccagcgggaagccggtggcagcgaggcagatgtcgtcgatggtggtgaagcccggcagcggaaccttcttggactggtcgtccttgttcaggaagaagttttcacccttcttgttggtgatgtagatggtttcacggtactccttgccatccggcaggatcgccacgacggtgcagtttttcgcaccggattcagcctgaccggcgtacagcaccttgaccttgacgttgtagatgtcagtggccaggggcttgaagccaccgcccagacgatcttcggattcttcgaggccggtggtagtcaggttgccaaacagattgctcatgattttttctctcttgattcagttcagggtttgggcacaccacaacggggactagtcgttgtagaacttgtgcaggtggtccagcaagagctggcagtcgttgtccatgaaggtttgcgaacgactgaacatccccatcggtgaacggatacgctccccggtggtggtcttggtgggccgggtttggaacacgtgcttgtaaccaagctcttcgtcttcctcggtgatggtcaatagatcgctctggtatgcttccagagttttcagatccaccttttttgctgccaccacggtggagaagtaggcttccacaccattgcctttcagggcacctttgatcgggaccgaggtcttgatctccattgccttttcgttcagctcgtccttcacgtgggccgtgaagataacgggcttaccgaagctcgccaccttgctttgcatggtggtcttgaagaactgctggtagttagaccagcctttcatggtgtcgtgagcaccgagcacgtacagcgattcgaacatgtccatcaggaacgtcagcgagtcgccgatgatgcccttgatgtcacgttctggcaggatcgggttgccttcttcgtccagcagagtgccggtcgcatagtcgaacgcatcatgcacctgatacggatcggtgatgatgtgacggtcgaacttgttcttgaagggcagacgcttgcctgcttccgtgccgaggtacagccaatcctcttggtcacggatgttgcggagactggccgacttgccggtggcggattcgcccacgacaaggatcagctgatcgttcatttgctcttcggacatgtgtcctcctgagtgcctgacagccatgaaagactgtcaggcggttgcgggttacttccgagagaagcgtttgccgacagtcaccatgatggtgctgtcgatttcttcctcgtccatcgggttgttcagcttctggttgaaagcgtgaacctgacggcccacttccagaagggacatgccgttgtccaccagagccaaggcgaacttgatcatctggttgttgcgattgccgttggcgatacgacctgcaaaccagcgttccagattgtcgagagattcgactttctggtactgctgctggtacttgtcgttcatggaagtgcgtgggatgaactgaagcacgtccagcaggacaggctctggcttcccttcttcggtggcaaactcgttccggtagaacgtcccgccactgtaggtttcccacttcttctcggcttggttggccgattcgtccgtagcgaacggcagccagttcatcaccgagttcatgaactccttgtagtcgtcatggtcgaggtacaacttgaagttcatcggcaggatcagacggaaacggtcttcacctacgatgtcctcgccctcgctgtccacaccttccacctgacgatgacgtttggtggtgtaggtcatgaacttgtactcagccatcagctcatgcacagcagccagactgacaccaccatccacgtcgatgatgatggtgttgaacccttggatcacgttttcacgtgcccggtggccggacttgaagtggtggttggcccagtgcatgggcgagccgtcttcttgctctgcttgggtcagcaattccagctggctgaagggcacctcttcgttgctgtagccgtaggcccagtgcgtgccataggacacgatcagctcgtcgaggttggtttcctgcaacttctcaccacggaagaactcgatgccatcgacgaatttcttcttgatgatgatgttccggctgtagccagcggccacggccatcgtcatcagctcgttccgtgctgcgttgctctgcttgtagaacggcagggcctcgtgcaggtcagcgtgagtcaggtcagtgcctacgtcggcgatgtaacgagccaacttcacataggccttctcacgggtcaggatgcgtttgaacgctgcacccgactcttccaccagcagaatggactgcttcagatggtccatctcgatgttcaaggaaccgtcgatgaaggccaacgcaccagcgagcttcagagccttgaagtagcgatgctccatctcggccttacgcatttcctcgtggtcggccatgctctcggcagccttcttgcactcgatctggtaggtcaacagggcaatgcccacgtcgtcctccaccttcattttccagccgaatacggcaggatcagccaagctgtggaaaatgtccgaccacttatccaccgtggcggagttcgtggggttgatcaacccggcgtaaatctcagccggggtcaggtgcaggtgagccttcttctcggcctcaccccatgcgaacaggcaacgacgtgcgtagccagtgtccagcaaggagtagaagtcgtcttcggtcggcccaccatcgaacagcttggacggagtaccgaacagcagcaagttcgccggggttttcccgtcaatctcttcgcctcgttggttctctgccgtgttcttggtgagcttaggcttcaccagaccttggtcaaacaactccagatacagagccaatggctccaaactggcatgaaggttggtgccgatctcgtccacctgcaagttcaaggaaccgcagttggacatgaccagcttgttacgcagctgcttgatcgccgggccggtggccgagtcgaaggtgaacggcaaaccgcctgcacgcttccactcggcttcggctttctcgaactcttcctgctggtcagtaccgttgcggactgcccggtcattggcgatatcccacaggtgcttctcggagacaactgggaaggtgtcttccatgaaacgcttgcggaaaccggcaaggaactggttttccacgatgttgacggagtgacccttgccgtagccagaggtggccagagcaagtgcataaaggttgaccgggatctcgccacggtctttggtgacgatagtcgctcgcatgcacgaagcgatcttggcgaggaagtacgccacttccactcggaagaagatgcggtcggtgttctgtgttttcgagcacaggacatcgacgatctcttcaattgcggggtggtgcgtcaccccggtcaggtcgatcatgtgttacctcggtgatcagatggattggtatttcgggaaggtgtccttctggctgcatgcgtcgaaagcatcgcagtagtcgcagcgctttggctcgcccttcacggtgatgatggtgcccttgttacctttgctggccatgtactggcgggcttcatccatggagtcgcagttcttcgtcgcccggccacctttcatggcggtttcggggttcgaatagtacttgtagaccggatccgtcatccacagctcttcgtcagtgcagtgagggatctccttttcagggacacgcatatagcgttcgatctgctccagcttgttcaccacccacttttcagtgtcggtgatgtccaacagagggatatccttgaactccagacgctgctgggggtacttcggattggtacgggcttggaacttctgccagtcggtgaagatgtagttgatacggatgaagtcctcgtggatcttctccgggttgagccagcgatacagggaaccctgcaactggtgctcatcatcccggccaccgtacaaccacgtgtaggccgtggtggtcttggtgtcctgcacgatgccatcagtcaccatgtcgaacttgccaccaacagtccattcaccacgggttgtcttcactttcttgaaggcccgctgctccacgtaaaccaatatcgggtcgccgagcttttgctctttgaagctccgaatggtcgcctcgtccgggttgaccagtacacgtgcaatcacgtgatccggggtgcccagcttggcgaggttacgcttgtagttctggacccaagccttttccacggaatcgtggatggagtggcccaacgcacgctgcaccatgtcagcaacgtcgggggcttgccgttctgcttccgggatacgccggggcagaacgatttgacgcaacggcttcatcaggctggtggccgagatgtaattcggcttggactggtagtcgtagtcgtcattgacggcccagacagccagagccagcgagatgccagtcttgttcgtgatcatcaggtttccccttggttcaggctacagggcggtacagggcgatagccgatgcctcgctggagaacggccagtaccagctgtccacatcttgggcaggattgatggtgccgtctttcaacatgacttcgaccatggcacctttcggcaaccaagctggacgtttgccagtgttgtccatccagccgtcttcatcggctggtgggatcgaatgaacgaacacaccggcccatgcacggggctcaccggcacgcttacggtacaggccccagtccaccatatcggcattttgtggtcccatcaggtcgccattgacacgacgcatggtcacgatggacttgggatgcaagccttcgggcatggtgccgatgtcggcgttgtaggcgtaccacgtgtcatattcacactcgctgccttccattaccggcaaaggctggtgttcagcaggctcaaccggcacttgctcttcgctggtgccggacatcagggcgatgtaacggttgagggtgtcccgtgcctcgatcacgtccttgagcatggtcttacccccggagcgtactccggggatcagcagcttcttccgagcgtggatgatggtcccggtgggatcatccaccgggaacatggcgttgatgacgtaggtatcaacctcgtcaggtttgacgccgggaggcagggccttgtagtacttggggtacttcttggccaaggattccatttagctcaccttggcaggcgagtggtcttcctcgacggcaggttcgccatcggagacgatagacgggccgaagaactcttcgtcggtttgcaggccgaggcccgacacggcgatgatggtcacttgaaccggctggatttgcaggccttggttcgccgcaccatcggatgcgacttgcatcaggccacgggtggcgttggacaggtcagcaccagacactgccggggcaatggtcttgatggtgcattgcagggtcgaggcctgaacctcttcaggtttgccgaccgggtggaacatgacttcaccggatacgagccagaagaagtatgcaggggcttgcggtttcgcttgagacataacgctctccaatgaaaagaggggtgaggggatccccaccccatggaacaactacggggtaacttcagtgaccccacccacgcattcgaagacgagcttcggcacacgggcgttttcgccagatggcgaggtcaacagcacgtccacttccagcaggccaactggccagctgtcagtgttgctggaagacaccgtgatctttcgagcaaggttcttgtccacccacttacactccagctcatgcacgagcccgtcaggctgccgattggcatgcacacggacctgtgacagtgggagccagtccgccaacgaaccgtcaacgtactgcggggggatgtcgaaggtgtgggagaacgagcccccacggatgaagcgagtagggcggctcatgctgcctccaattcgtcgatatgggcctgaagtttctcacggatcacctcttcggttgcaccgttggggatcaccatttcttcagcccacgaaggatagaacagagacagttcgccacctaggcctacttccgggtggtagatatccgggtggtcgttccagttcacggcatcgaccaagtgcttgttcatgaacagcacgcaggccatgtcgtcgcgtaccaatgcatacccggcgtcgtggatctgtgcacaaggccggatggccttccgcataaccgggtccggtcgaacatggacacccatgaactcagaccaagcccggctgttgagcaaacaccagccctggcccagtgcgttaccagcagttcggccttcggcttctgcctcatgcggagtcctactgtttccacgtaccacttggtgaagcagtggggtacggacacgcagcccgaaggccgttgtcacgtagccacagcgggacgcttcgtccagcttatcggccacccacttgtcactcacgacgtacagctcgtggtaacgcttttcaaccgacttggccttggcctcatcgaaaccgcagttcgtcatcaaggtgatgtacgttccttggtacgtcagggcgaaggtcgggttcttcgattctgcccggagtggcttgtacttcttggcgatgctgttgatggactcaacggagttcggatcgataccctccatctgatcaccaaagtaggcataagcacgcaggcagtgaccgtcgaagccgtcggtgtagaccttgagcttgttcgggtctttcgtcgtgagagccgagatccggtcttccagcgacgagaagtccaaccccatgaacaaccatccggggggagcttggaagcaagacttgatgtacttgccgtaacgacccttggccgtggcctcgccctctgcccctgctggcaggttctgaaggtttggtttggagctgctcaggcggcccgagacggtgccaccgaggttgaagttgccgaacaggtagtgccaaccatcgagtcccggcacagcccccttcagggccttgatgaacgtgccgatgattttgtccacgtccttgaagtcctttagggccttcaggaggtttttgacctgctggttcttggcatggttgaccagagcatccagcgagtcgccatcggctgacggttgtttggtcttggttcgactgagcactggcagggccagttggccgaatagcagctctaccatgtcgtccggggagttcgggttgaactcttccttggcatcggccatggtgacccgcttgaccttcagctcgctgttgcgtttgaccacccaccgttcgttcttcgcatggacgaactgttgaaccaacggggaactctgaatccggtgcatggcgtctgcccgctccttctccagaatgccttccacttcgagcacacgcttcatgttgaccggcatgccagtcaactgcatctgcacgatgtcgatggtcgcaggcttgaacaccgaggtgtacggatcaacctgctggtcatggaccatctgcgggtggcgtttctcatagacgtaccacgtggacagggcatcgacgaggttgtattggagcagctttggcagcttgatacgtcgaatgtccttgatgtcctcgcccattgagtagttgccagcgaactcgtgtgcttggtctttcaggcccagcttattaccggcacagctgttggtcgccagataggtgatcaacttggagcagtcccagttacgaagcaggacttccagaccttccagaaggccgtcctgatcgaggatgtcggtcatgaacagctggtagatcagcacgtacacgtcgaaggcgatgttgtggtagatcgctttctgcatgaacagcctgaagaactgtttcagcattgcacggacaggctcgttgtagccttgtttgccgtacatttggacctctgtcttcccgacaatggtcttccactcttcgctgatgtagtccacggggaatgcgatcccctcgtgtttgttccatgcgaacgagatggtcccgatcccgcacttgtggtgcttgaggtcgaagccttcaatgtcgatggtcagcgggcagtccatctccagcagccgaatcagccactgctcaatgtcctctggccgagttgggtactcagcaaagtggatgatgccggagccgggggcctgatacgtcccccgagcagcagcacacaaggcgttcatggccatgtcgatcttggctttcaccttgatcgggtcgtagaacattgccttgtagttgggcacatagatgaccttgaagtcacccatggtgcagtccatcacgtagccgaggttttcttccaccttcgcagccttggtcatagccttgaagtactcggcgtcagtaatggccacgtacttgaccttgccagctttgaggtaaggaatcacctcgctggtgaggtactcacgcatttctgccatcggcgtctttttcttgccgggggcatagtgcaagtcgagagccatgacggtcttggggtcaagtccgtatgggtcgatgtagtgacgcacgaagtcggctttcttgatctgtggaaccaagaagcaaacgtcgtagtgctctgcgtcttcgaacgtgaggtagttcatgtgcagccctcagtagatcatgccgcacgcccagtacacgtcgatcttgtcacgcatcaacaggtactgactgtacagccgttcgttacctttcagggtgtaaccatcttcgtttgaccggggatgttccttgaggctcgtcagattaacgatggtttccggcaatgcattacgcacgtccagtaccgtctcgcaatccttggtcgccagccacagaacctgcatgatgagctgcttatcgtcttcgacgatcttgtgctcagccacaaattgggcagcctgtttggatagagtgaaggccagcgacgggactgtcttgggacgttgcttccctttcgggacatacacctccccagcatgcataaagcccggaacggtgtacttcttgatctcacggttggcctgatcgagttcgatgaccaaactgttgagtcgtctttcctctggttcaaacagcttatccacagtttgttccagaaagctgtgcaggttctggatggccattagcgaacgaggcctccgaacttgggtgccaattcgccgtagaaggcgacacgcacacgggcacgggacactgccacatacagctggcgggccacctgagacacgttgcggcaggtgctgaggttctcagcgtcgatatacacgaccgggtggctggagccttgggccttgtacacggtgcgggcgtcacgctggcgaaggtctgggaacttgcccttcaggtcaaagtacgacttccattccttcaccttgctgaagtacttgatcagctcggcgtaatgctcacggttgaccggcagcgggattctgaactggtcaccataggcgttttccaccagtgcctgccgcacttccagctttgcaccacgagccagctctaccgtatcggtatagctttccacggacaggatcctcacctcatcctcaacggagaaaccgtacttgccaaagcgaggggcattattggagatgagggtttcaccgggctggaactcgtatggcaggccacgcaggtcacggatgtaaccgttgtagtccacaacacggttgttggtgtaggccagaatcacgttctcgtggttcgggtcagccagatgggtgtcgatttcgttctggaactcttcacccgacagccagtcgatgatgcccggaatgatctgaatcggggtgaagtcgtggacgtacacctgctcgttcttgtcgttccagtcgagacgaccggactgcaccacttcacgcatctgctggttgagggcttgcagctctgggatggtggtccgcattggctccagcagctcgaacatgttcatcttgtgccggtacaccgggctcagctgctccttcacaggggccagctggtctttgtcgccgacgtagacgatcttgcagccttcagtgcctgcctgaatttcgtcatacagggcactatcgatcatggacgactcatcaatgaagatgatcttgcccatgtgcttgtaccagttcttggtacgggtgatggtggtcgagccatcggtgtagttctcggtcaccttcaagttgaagaaggtgtgaaccgtttcagcaggccgaccggtctgcttgcccagcacctcggcagccttgttggtggtcgccgtcatggccacgctgtggaacaggggctcgatgcctaccaacttgcaggcgtcgaaatacatcgggaggatctcgtcgatgaggtggcccatcaggaaggtcttgccgaccccaccgggaccactgatacggacctccttatccggccccatgaggaattcgaagaagccgtccgaggccagcttctgtccttcattgaggggcagctttttcacgtcttgcaacatggggtggatctcctactacgaaaaagcccggctcaatggccgggctccttgggtggttgactcagaccggcacgaagcggttgagtgcggccttgctgtacagtgggcctttgatgactttaccgttggcgtcatgcaacgggttgccttcagcgtcgaacttgctgaagttggagcggttgacttcggtcatcgcccccacgaaatcataaccacgggtgtaggcgaccccggtgccagtgaccacttggtcagccagtgcgtcgaggaagagcacttcgctcttgacgacgatcaggacttcggtggacttggccttcaggtgctcagccagttcgtggatagcacgataggcttcactgatcaggcggtcggtcaccagatcggtgccttccagttgttccagtgactcggccacttcctcgtagtggcagcccagctgggagttctggtctttcaaggacggctgtggacgagccagttggaaccacagatgagtacgcgacaatgcacagttgttgttcatgggtttccttggttcaggtaggcctgtttgatcaggcggtatacgaaggtcttaacggaaatgccctgtcgggcgagttcatctgctagccattcctgttgagtcgcatcgagacgcagaaacacgtcctccatgaaggtacgacgggtatcggcaggctccacccccaagcgtttgagacgcaaggtgacggtagtcgggtggcagccgatgcacttggctacggtggccagagaaaggccaacgctgtttaggcgaagtacatcagcatcagaggctttacggttgacacgaagaacggacgacatagggggatgatctccataaaaagatacctctagtctattacgactagaggcatcttgatacagcgattacagcttggcccgctcggtgatcttcttgatgaacttggcgtcagtcacgccgaggacatcccaacccttcttcgctttctgcttgaaggcgacgatctccttcgcgttctgcttgtccgggttgcggttatacaggtccacaaggtgggccatttgctcttgctgggtcatcttggtcttcttcccttcgggcagaggcgaccccttcggagcgaaggtgtcacgagtggtggttggttttgccttcacaggcttgtcgatctgctgcttggtcggggccttggccttgccagtggctttcggccaagtcatctgcttcaacagcttgtcgtcgttggacggcacagttttcggcagagactcggcagctttggccatgttgaccatttgcgttgcctcgtcgaagacagcaattggtacgcccagagcggcccacgacttcttggactgcttcttgaacgccagcaaggccttggccgcttcgaccttggcatcaatgatgctggcctcttcgaaggctttgaccagtttctgtactggagtcagctgcttctcagcagctttggccggggcaggaaccggagcagctttgcctactggttcaccagcgacttgcatctgggcaggcggagcgtggaacttttgctcttcctgtgcaggtgtagcctgcgacagggccaatgcacgggcatcaaccttggcagctgagcagttttcagtgtccaaatgatccagcgagttggacttcaggctggagtccaatggtgctggctctgcggtcacttcaccagcaggggtgattttcaggccaccgcccttggcaccggtgatctccacgtactccaaaattggagtgtggttaccagcgacggcattgcccagaaggatctggtcttccatcggctgatcacgttttacgcgatcacgatcaccgtccgacaaacgggcgatgatgtggtagcccttggcccggagcttacgagcgtcgtactgaggtacggcgatcacgtcctccggggccagcttggccaacacgcacacgtcaccactgaagctacgcaggtagtcccggcgagccacgtgcaaaccgttggagcagtcctgtctgcggttcgggtccaccatgtgctcggccatgtggacaaacgagcctacacgctgcttcacgttgccggagtggcagtccacgaagacaccttcttcactggtggacttcagcaacttgtagaccagcacactgccgtcgtcagccagcggcagttcacccttctggatgaacttgagcaggtcttcgacggagtggccgcgtttgatggaaccggcacgacgcaggaagttggccatggcatcaccggagctgacgcccgacgatacagccatagtctgctgagccaaggcctcacagccggggatgatggtgttgtcgtccagcacggcgatgacggtggtttcttcctcgccttgggcatcttcgttggagaagccgggggtactggccggaacagcattggccatgatctcagccacagcggctgcgttcttggtcagtggacgctgttcttctggagtcagctcgacaacagcgtcttgctccagctcttcggcctcgggagctggggccgtagctggttgttccgctggttcctcggccttgtccgtagtgcccatgacgacaggcatgatgggttctgcgaatttctccagcagctccttcgccttggtcctgaccatcttgaagaaacgggcgacaccgcccatcttcttttcggtttcggcgaaggtgttcttgtcggccatgtcgtcctcggtcagcatgtagaactgcggaccttggggttcaaaagccggaaccatcttcgccacgagatccttcaggcgaagatcgccttggggaatgacgatggtttcaccgtcatccttgtacagggtgacgttgtgaacatcgacgacgcagcacacgatcttgatcgggtagttcattgttgcacttccttcagaagttgacgggtaagttcatacgggatggcgagtttctcgtcacccggagcacgtgcttgcagtgcttcgccgatacgttccagattcacgtaatgagcccatggggagtcacgcagggtacgcttcaactcggtaacttgagggtgcttctgcaccttttcagctagcaggttgcatttctccatcttcttcctgaagccgtgaaagctgctgtcttcgaagaactgcacgagagtcatcgtctcgacagagatggtgaagcggaacttgaacggcaaggaatctaccagttcttggtgcaggcacatgttacgcaggatgccatccacatcactggcatgatgatgtgctgctgccgggaagtaacgggtgaacgccaaatagcggcggaaatcaggtgcagccgacaaagtgtcgtccacatgctgagcgacgtatttactcacttcgggaatccccttttcgatgaatttatctacctgtaccgtggtgatcacagcaatttgcttgccccacaacttattgaccaattgagacatcttagggctcaggtcgctgaagcggtcgcaattctgttgggcgttgttgaggaccacataggccacagggtcgaatacgtgttggtctgggttgtccggttggacgttcaagcgagctacactcaagaggaagttgccgtcgccgttttctgctgcgtgcagcggcaggtagcctttacgcttgacggtcggcttcttcggagcacgctcttttggctcttcgccgggagcacgctcgtaagtggcacgggccgggatgtacgtgtgaacgtcatagcccagcttttcgaacacggccttgatggcgtcatagtgcttctcatgggagggcaactgatagacgacccagccggtacggcgcttgtcccctttgttgtggagctgctgctccatgaactgcttgatggcagtttgggagcgagccaacaggacacgcttgaatgcataaccgaacagcttgtgtggtgtatccgggttttgacgccacgggttgatgaactggatgctggtgctatgttcgtagggctcgtagacatacgacaaacgctcgatgtccatgaactcttcggccttcacagcacgtaccagcgggccagtgacccacttgtccaaagcgtacttcatcagctctggtggccgacgacccggatagctcactttgcccttacgcatagcctcgtacagtcgagcagccttcaagaaagccttgcccatccgcttgtccatgcccggtagagtgtgaaccgcatggtggaaacgcttgattaccatgtccggcccgttgtaggtcagcgaacggcgagacagcatctcgtggagtgctgcccgacgaagttcgtaggcccagatgccagcctcgtgttcagcgatagcacccttgatcacgggcaggttgatgtctgtcacgaggtcagtggtacgggtcaccggtggagcttcacggatgatcttgttgaccagcgtggcgtttacctgacggttcacgtgcttgctgatctctgcttggcgagggttgaacttcgccaacagttgcttgatcgtctcgacggtggtgtcggtgaagatcagagcttcccggctaggggcgatggagatggtgtcaggctcagcgaggaaaatgatgttggctgcattccacagctgttgcatgttcttcgtgacctgatcccacatttcaccgtagtgatccatccggggaaccgggtagaccacgtttccataacgcaggttgatcttctgggtcagagtgcctttgaagctgttgatgatgtagccggtgtgggtgccgtcagtaggcagcaccagcacacgctcaccattcaggtcagcatggatctggccgaggatcagtacctcgcggatcaggcgaacaaagtcagcagcatcatgcggcgacttcagggggatggtcacacggatgccagtctcttcggttggcacctgcacgatggtgtcgatggagggcttgcctcccttttccatgctcgacttgctcacacggtagaccgacttgacacccccgtggtgactgatcacttcgaagttgtcggtgtagctgaatggggccttggatccaagtccaaagcctccggtgaccgaaccgtcgtcacgcttggtcgagttaccgaacacaccgtaaatcgggccgatcttttcgtgagggatgcccggaccgtagtcacggatcacgatgttttgctcatcgacggtgatggtcagggccttgtcggtgcatttgccgacgatgtggccgtcccagccgttgcagatgatctctcgcacggtggcgagacgagggtaggtatagagagtggtggagaagatgtgcatcagagccgcactgtcgctcacacccatctcaacggattctttcttgccgagaacggcatgagttacagcatcagacatctggctgacttgcatttcgatactccttgaggaatgaagcggcccctgttacagggccacgaaccaagaaagcactagaacggagcttcttcgtccatcaggtcggcgaagggttctggaggtgcaggcttggggatggatggaaagaagcccatgtcgaaggtcttctctgggtagtcacgcaacagacgtgggtcggtgtttttgccggggtactcggcagcacgtgtctcttcgtcaaatgccttggagtccaccttctttttcggaacatgacgggatcgccgacagccataggtcatgccttcgtccatcatcttttcaacgaggtagtcagcgatctcgcccatggtacttactccgagatgtattcgccttggaccatcttgcggaattgacgccaaccggtcaggtttccgtgttcttccgggtttgcccagccttggtagaagtcacggtcatgcggatcgtacagatccggcgtggcctgatgctccagtgggctggcatggatcggctgggcaccagcgagacgctggtacagctccagatccttttccacagtcggcttttcgccgtcgtgggtcaggtacgacacacgggcacagcgggcagcagacatggcgatcagcacgttgaggatctcgctgctcgacggcatgtcacgggtgatacggcctttcagtaggtgattggcagcagcttcccagtcggcttgcatgtccacgtagggcaggtgccagtcgttcaggccaacatgctgatactggataccctcacgggcttcagccatcagatcagcaagatgcttgatctccggctgggcatcagcatgacgacgcaggccgtcgaagttggtgaagctggtggtcgtcatgatgacgtgcatccactggaatggctccagaatgcgattggccacctgcttgtgtagccccagatcagccagcttgccagccagttcagaggcatcacgagcaccgtcacgccagtgcttgatagccagttcacgaggatcgtggcccaactccagtgatgcttgcatccccggttgattcataccccagtgcatcggcatggccgggtcgttacgcacttgctcgatcatcttggctaccggtatggcacgagacgacgaggcgttgcggctgaactcacggtgagtcatgaactcagcgtggatgaagcgagggtacttcagctgcatggtggtgatcgggtgcccggacggactcaccgaggcgaggatgacttttgcttcgaagcccatgacgggttctccttggttgatgaatgcctgaaaaagaaaaaccccctcatttagagggggttttccatggcccaggccgaagatgtgttaggcgacagcaccggcacctacgccgatcttgcccttggccacctcgctatcgttgacggcgacgttgaccagttcggataggcgataaccattgctctcagcggtcagggatccactgcacgttcgggcgaccgaatcgacgctggccatgtaagcctgctcggcatggaacttggcaccttcagcaccgtggtcggtgacgtaggcgagggcggtgatcagatcgggacgcaggtcttcggcgaagacagggccagcacacagggcgagcacgccgaggcacatgccaatcagtccgtggtacaggcgtttcatgatacgcatagcagagtttcctcttggttcaggttgggagaggtaaagttacctcgaatttacgcctttgggaagcgcatgatgtgaacttcggcacccagctcgccaccgagggcagcgatcagttcacgcagttctttgggcagctcgtcttcaccgggaatcgggtcacgagtcggagcggtggcagccggggccacgctgtctttcggcagcagatccatcagggtggccagcacggcatctttttccttggaggcattgatgccttccaaggtcttggcagcgttcgccagagtgacgatggcctgtgcgttggtcacattgacctgagcacgctggcggtccagctcgacctgatcgaacaggaagtggttgtgggcctgctcaaccatctgggcttggccgatggatggctcagctgcatgtggctcgttggcctgagcggcttgacgtgcttccagctcagcacgcagttcacagaagatgcacatatttcactttctccgttggaggggggttttttgtgcttcgtccagccatttctgaaggttctcttcagtcacggtctggcctatgcactcgttgatgagataggaagcgaatcgttcccaattctcaagttccttgattcgctcgcattgctggatgatggtctgtcgttgggcagcgttcatctgctccaacgtgcgagatacctcggccatcagctgttacccagcagaccacgcaaggtggaacgcagggcttccagttcagcattacctttgccagcttcgaggatggcggagtcaacctccatacccagttgctcgacttcttcagccacttcacgcagcttagtggccatggtgaagcagcgatccatcaaggatggctttggtgattgggcctttttcacaggtgcagtcacaggggcctccacgggctttttagatttcgggggtttgacattggaacggaaggtgagcatccctgtctcggttaccagtccagcgtcgatcaggcagcgaaggcagccagagatctcagctttggacaggctatgtttctcaacacgggccatctcgttggagatctggccaatcgaccagaactcctgcatgggtacagcagcgaacacctttcgggccagattggtctggccggacaggatgttttgggcacgttcgaattgcatcagccaagttcctcagtgatgagttccgacagtttccgagcgttctcttcggctgccggagtgatggcagtaatatccccggaatgcagtagaagattcactgcccgcaggatagaacgcattttgtggatacgctccccacgctcaacactaattttctggtgatgagcagcgttgctactggcgacctcgacttgaagactcagcctgccctcgcttggccgcacgaacagctcgcttccctcgggagcgaggcttagatcgatcagggcgataccaatcctcatcggaccaatccccggaaagtcgtactgaatcgaggtcactttccctactgggctcagcagggacttcttctcgctggtgctcatgtgtctcttccttcaattgggcaaccaactggttgcacttttcaatgaacgccatgacagcgatgaccataggtgcatcgtccatagcgaggaacgccttgagcatcttctgatgcttgagcggaaccaatgggatctgtgcctttatgcagtcacgcagccgggccacatcgttgttgtggtaggccatgttgaactccaaggaaaacgcgacctcatcgggagtcttatccccacttggttccacaacccggaggttctgcatccatttggggatatcgaagacattggaaggttttttctttctcattactccgacctaaaaaaatgaggcccgaaggcctctaatggagggatgttggtgcatccgaggtgacacaacagcaaggacagtgattgaacacacgtctacaggtgctgagtcacctcggatgcaccatcacaaggatggtgcatccgtttgaggcgctcgccttgcggctagccccggcgcggccaggaagtgctgtttactcggcgctgtcgcccttggtcaggcgattgacgacggtctggtagctttccttgacggtcacttcttcaccggtgtccttgagggtgatgaccgattcgctgccagattcactgacgaaggcgatggcatcggcggcgatcagaacacgttggtcggtgtcgtaggacttcagtttgaggaacttggacatgcttttgtatctccatgaatgcaactgggaaggcagttgccacctataggaaaggtgcccgcttacatatacgggcgtgccccttaaagaactcctgtgtactgaggacttttccacagggcgtggggaagaggtgcccgcagagtggattcgaaccactgacctccggcgaccggcgagacgtaacgggagctaccctatctctgtggtggccagtgctctaaccgactgagctactttgggcattgaaagctacattggccgatcaacagtgagggcgtccccactgtgttgtgacagaacggaatcgaaccgcagctgttgatggtcttcgagggtaaacctctacttgttactcatgcgccctgcgccttacagagtgacccagcctgtctcctacagcctgttgatcgccaatgcagcttcctgtgactgcattgggctttgtccggtatgctccggtctttccggggtgattcaccccaagaaaggctagctttcctaacccgctagggcagaaaaactcagtggaagatcgggaccagagacggtcgcctcttcgaactgcccttgagcctttttgatgaaggcacggatctgacgagccgattccttcacttcaaagttcaagttgtcggctgcttggatcagcgagcctttgccctcaccattcagctgttcaacgctgatgatttggtcggaatttaggtctacccggttgccgttgctcagccgggtcactcggatgaaggtcatagttcagccctttcaatgcacggggctttcccccaagaaacagctcggtgttgcatgctggacatgtcaacctaccgtctgcaaattcaacggtgtagtaccgtttgccgcacttgcaggcacggaaaccacggtacaccccattagtgaaaaccacgtcgccgttaccgttttcaacacagtcaccgcaaacgtgggagtacatcgggtcgatgagcatccatgcgttgggcttgttacacccttcgcatggagcccccggatcaggtgcaccagtcacttcgattcccgagccggaacgggacggtcctcttggtgttggtacttgccctcgtagtgggcaggctgacttgtccgatggaagatcacttgagcgatccccgaaccagccgggatcagcagttcttcttcaccgtgatagaccagctcaagggtcagaaaccctttccaacccggttcgatcacggtgttgaagacggacaggccacgacgagcccaagtggacttgtcgtggacgatccctgtcagatcgtccggcatctggaactcgtccatggccgaggccaaggcgaagcgaccgaccttattcgtcagccgtctggctaactcgttgtccttttctgtttgaaaagattcaacgtgcatgaggcccgtctcaccttgacggcggaaacgcatagactgcttgatgcggatgtcatagccagcctcactgaggccagccgaggtgccacccttcgcaacgaacttggtcgtggccatgtccttgatcggggcagcgtcgagtagtgcagtaccattgatgatcacgagctagttcctcatgtgaatcagtttcccgaactccaccttgcgaccagcagcacgcacggcacaccagatcactgggatgtcgaaaggcagcttggccatggggttgcagtcaaggtctgagaagacgatggcagcagtcggtcggtgcttcagcatgtgctcacgcacacacaccagcgacgtaccaccagtgccgtaacggacggtttcctcgaagggatcctcatccaagaaaacgctctcatggacaatcgagcacgtgaactgcaccagcgtgagtttctcaggccggagcacttccttgatgaatttcacctcggagttgaaacgcagcacgtcgtggttggagcaactacctgacacgtcgaggtagtacacgatgtgccggagccgttcttcttccatcgtcaccgatggcagatagacccggtgggcgtaacggcgattggggcgagcccacgagtagccgttttccaccagatcagtacagaactgcatcagctccttttcccatgggacaaccggggcaaggaacttgtccagcgtctcctgaatcacttgagggatgttgcccgaaccaccggccagcttgtgttggtgaatggcacggaggaccatctcaacgaccttctgtgcatcttccttacttggttcccttaggtcaccattgccccagtcaccttggcccaagctgggcattggtggtggtgggactaggacaccggagctgatcaggtcgtagatttcttcttcggccagtcgaccattgtcgtcaatcgacggatccagacagcaccactcaatgtccttgaaactgaagccggacacgagcaggtcgttgttgatgcggtagtcacaggcctgattccagatctttggatcacgcccggcacgacggatgccgtgcagcagggccggatgccacagttcgtggaccaacacggttgcccgtgtttctggggtcagggacatgaagaagtccgggttccaccagaccttgcggccatcggtttcagcggtccgcaccgtttcgtcccacacgaagtccaacgagcagagcaccggacccaagaaggcagcagtgcccttgttcatgaagaccttggacttggttttatccaactccttgtcgagtgtttgctcgtcgaagttcatgatcagtcagcctcgtaggtgtgttgggtacgaatgcccggcaggtgaatgcgtcggcccatctctttcaggatgtcctgacgttccatgatccgcttggtgatgcgttccttcatttccgtgatcacggcttctacctgatcaggattgccagcccacgccttgaagtagcacaaaccgtaggtgtccatgacctgctcgggaacaccgagcttgtcgaaggccacccgacggttattctctgtcttgaacaaggacgtgcaacgttttgccttataatcctcgacgctgaccttgaagccgtggtcatagccgggagcattggacagcatcacacccacacagtgaagcgtgcaattgtggtccattggttcagtccttcaggtagttggccagctccagcatagccttgacgaacggtttctcctgacggagggacttgtcggtgatcatcaccgagcggaagaacaggatgcggaacgacaggtcgaagcggttcgcatagcgagacagcacgtccagcgtgtccttctccacgtgctccagcagggacgagatggtcgcccacttcgtagcgttatcccgagggatgaagtggttgtccgggtcgttcatgatgtcgtcgatcttcgggatcttgtcgaaaacctcgcagaacgtcacgaagtcggcagcgatcccagccgtgatggtgccagccagcaacggcgtcttcccttccagcgaacccatcggcccgatgatgcggtgagcgaactcccacgtccgtggacagcagaacgtcttgtcggtgtgatccggcttgaagtccatcaggcggcccggatactggttgaggtacgcaataacacgtttgtcgtacttctgcggcaaggccacgtctttcagccactcttcgaagtcttccaccatctcgatgtggatcacacgagactgcatggcagtagacagagggttgacgatggcccggtcagtggacaggttaccggcagcagctaccagacagttgtcgtgcagcttgtgttgcccgaccatgcggtcgaggatcagcttgtaagcagctgcttgggtgtctttcttggccgagttgaactcgtcgaggaagatcaaccagccgctgtagcctttggggatctcggcatcagccaatgggaacagctcacggaacggagcgaagtaggcgtagccatccttgaagtcaggcaggccggacaggtcttccggtgggctggtgctgagccggtgatcgatcaggaacaggttcagctctttggcgatgctcgccatgatgctggacttgcccagaccgggagacgactgaaggaacggcaccagaccggcatagagcacgtcgagtacgaactcacgagcctgtcgtggggttgaacggtacaagctctgggcattagttgccatgtcactcttcctttgcataagggaacggatctgggtattgcttacgcagatcgtcgaagatggaaccgaagctccagctgaagaaaccgggagagtagttctccacggtttcgatgagacggccaacatccttctgttcgaaggtgtactcctgttggccgagatactgcggcaggatggagccgacatcagtctgctccacgagtgctgccacccgagaacacgatggagggtcagtgatgtactgtctcccttggttcagtgggatcatcccttctccttggcccgttgggcacgacgtttctggttggttttgtggctgaccatctccagatggacagggttgcagcacaagcggttgttgcacttgtgatcaatctgcttcttgccggggatgtagccgtaatagtgggtgaacaccaccaaatgaaccgctacggtttggctgttgagggacatgcggccataaccaccacccttgccgtcacccgaatcggggccggtccagatgtgacatggacttggttgcccatccacgatgtagccacggtcctctacgacgacacgctcatagatgcggaagatgatctccttccggcgagaggcgtcgatgatgccgcccacgcttggtggcagggcggcagtcattgtgtctccagcggtatacgctttccatcaacccagacagctacaggcccgcatttgtagaccttgttgctaatgaccatctcacccttactggagcaatccttagacagctcagcttgggggaggtatttaccagcagtgaatgccagcccgcaggtgactacggtccagatcacgaatgcgtaaaagccacccatgagaatctccttattggaaatgaaaaacccctcttacgaggggttctgattggtttttaaccccaagaaagggctacgtggcttcttgagccactactggctgtttggggatggaggcctcatagtcagcccggatcttagctacccaagcatccatgaaagcggcaatggcctgtttgccctcagcagtttcgaggaaggccgggatgccctgccatgcctgagagacgaagatttgcccctcttggttcagtgcagcaccaatggctgctttggtgcggtcgaacattgccagttcagccgacaagtcacgtcccatgagttgggaaataaccggtaacaaactcttgatgtccatttatggttccttgctttggtgggtggatgcctcaagggcatcgcggattcccttgctgatgttgccatcaccaagtttcttcgcttggcgaatgtgccaattggggagacgtgctgatacacgctggaggggttcgtcttgatcgctgtagacctttggtcgtcctactgctcgttccatgactgtatttcgtctgacaaaggaaacttattatggccccgtcgaaagacaaatctccacccacaggaatcttcccatggacctgtctactcacgaagctgcatcgcagcatcgttacgaaaatcttctcaaagcaatcgaggaacccaagatgagcgaaaccaaaaacttcttcggcactgacggcaatggctccaatgctggctggggtgccggtgttggtggtctgatcggtgctgccatcggtaatggtggtggcctgttcggtggcaacaaccgtgaaactgccactctggatcaagtggacagccgcttcaatgccctgcaaggccagctgaacgccaaccaagtcgaagatcgcatcgccgatgtcacccaagctgttggcggttcggctgctgctctgggtctcggtctggccggtgtcaaggatgccatcattgctggtaatgcccagacccaactggctctgtgcggcctcggtcacagcatgcaggctggcttcgcctcggtgaaccagaccactctgctggagagtgctcgtacccgtgagctggctcaacagaccgagatcaaccgtctgctggccctgactgcccagcaacactccgatgcgggtcacgcccgtacccaggtgctgctgaatcaggtcatctccgcaaagtaactccgccatccggggttaccgatctgagcgacgttgttgctcagctcacccggatggcagatgctgctgttgccagcaacgctcaagtggcttcggtcatcggggctgatgctaacggggttgaccgggttcgcaccgaaccactggcaccgtaagccgaaaggcattgagaaccccctcttttagggggttttcttatatctgaggtaaggaataatgaggcatttccccattttaattggtgactctttgccacaaagtggtcaaccagttcgtgaaccatatcgggtagtttggaatactgccgtggtttacaacgaccagcagcagtatttcaaacaacaacaagaagggcattttaaatcttctattctgaacacagctatactcactgatcatgagcctctggattttgagcccaagatgctcatgcttgatttcctgcctttggacgttaatctgacgggtttccctgtactcaccgcctctcgtcctaaataccctatcgttggtatgcgtgttaaccgcatccacgatattgcgaatgcggataggcgtaacaaacttcctaaagtattccagtctcagttcaccagtaccacagttttcgaggaaatggactactaccgttacaaccttgatgcagcaggtacaaagtacctttctctccgactagtcaggagtgccgtaagtcttcgtgcacgtttacgctactgccttgacgggcagactgtaatcaacagtgcgtatgctgagattcctgatgctcatagtggcacggcatccactgactctcttcgactcattgtttttggtgaccgtctggaattccacttgagtgacccaggagacaagctcttggagctttcctttgtcggtgaagtggtgagttcctcttcttcctttttggaaatgatccgtgaagatgacaaggaagatgggcaggatgtgcctgtactgtatgccattgatggcctgtacgtatacgatgggtattactaagtaaaataaaaaagcccctcaagaagaggggctttttgttggtgcctgttacggcttgcgtggagtggtccacgcctgcaccggcaggaaggtgcggaagtggctgttaacgatgcccacttcaacgatggtttcgccatcgccggtgaactcgaactcccacttgccatcagtggcacccgaacgggtcacttcgatcaggtcagggttttcggccttgaagtagtagccgtccttggtggcgtcggcaggcagaatggtgaagtccagcttgatggtttcgccgggcttgacgtaggtgtcggtgttgttgaacaggaagccagtcggcagcacgaaggtgccagcgttggtcagcttgatcttttgcatgtcctgaatgccatgcttggtgtacagcagctcctgcacgtggctgtagatggcgtggttgatcggcagcttctgggcaccggacaggttgtccagatcctcgtgagtcaggtcacccagcagcacgtatggagcagccggagcactgtcactggccagacggatctggacagtctgcatcaggttgctgtcacgagtggggttgaagtagctacgtagtttcattggttttcctctgatcagaaaaaataaggccaatccccgaagggactggccgtagtgtacatcaggacagggcatactctgacatcaggatgtcgtctgccaaagttgggtctagcttaccaatctgcaccttgtggcccatgagctgggacaacaggtcgctgagcatgttgctcttggcgatcaggtgcagttgcaggcggtactgctgacgtaggtcattgccgtagttcggcaggcagcggaagcagtcatggatggagaacacctcgaacggcttggcaggcaggctgttcagcagttcaacgatgtcatcgacattgaccagaccgatagtctcagtggtcaggtgatccaagatacgagcagacaggtagccagactgctcataacgctcccacagcacacgcaccatttcaccgtcttcgccgttgtcatccagatcctgcggtgcagggttctcgatggcataacggacgcgggcaatggtcttggggttgtagttgcaacggcgaccgatctcacgaacgatcatgccgtcgatgctgtgggtggtgttggcagacagtgaacgaccttcttgggtcggacggttcaccttgatgcccacgtcgaagtgctcaccattgaacagcacagtgctgtagtcaacgtcgattaccttgcagtggacgtggaagttgtcaggcagtacccacgagtagatagagcgggtgctatcccacatgtccttatagtacttgttgagttcccatacagctgggcactcttcttccatcgtctcgtggaacttgacgagcagtggcccgttgccgaacacacgcttcgggatggcctcgctgttgtacaggctggtcatcactgcggacttcaccatgtcacgagtcacacggccttgctgaccaaccttggccagcatcttcatgtagatctcggtgtaggcgtcagcacgtcgaccgatgttcaccacgttgcacagcatggcagcacggcggtcgccagtcaggcaggccagaatctgcataccagaggcagtggcatccagagcaattgggtatcccgttggttcgctcttttgaacagcgtcccatgcctgaacagcagcgaagtactgagcaggtacttcagctttattcaccatcatgccgaggcagtgtttgtggctttcaaaccactgaagccggacttcccagtcctccttgtccaagccaaagtgattggcgatgtccatctggaggtattgtttgccggtgaattgttgagtttgcatgcttcttctcctaatgagtgcgtctttgcaaatgaaaggttggctatttacgtttctctttcttttctttctcaagagcacgctgaatacttttcagcacaagttctcgatgatcataaaaatcttttacattccggcgatcattgtcattcattccacaatctccttatttgcgaactcgactactgccttgttccaaggagcaccttggtagttcacgtggtagccttggcagtaactgcgaccacgtttgtcatacttgtgtagcaagtggaactcgttcttgtgctcagtgatgatgtcaatcacctctttcgcagtacggtcatacttttcaaacgccttcttacggcgttcaaagtcttcccttggttcattcggcttgggtttgtccaagcctttccacttgttcttgaccatctccacaacagtgaagttgattgcgaacttgatgcggttctgcctgttgatatggtccagacagatatcatcctcatggtggttattcttgaggatgaggctgccaccggtgttcagcatgcccgtatcacggttgcatttgacctttcgtggcatcactaccattggcagtggatattgaaaacggtccagctcatcctgcacatcttggctgatagttgccttgacgatgaacaggttgaagtgtggcgaccaatctacgatgtctgccacagcacacttgtacagcatgtcagcagttgcctgcggatcatcaaagtgcttgttcataacacctaccaaagttggcaggtcacagcgtttgtgcaagttcatctgaactaacaaatcgaagccgaaccccgttgggatatcattggcctcgaagtaagcagcaaagtcaaatgtctcgcagttgatgaactcactcttgatgcgagtgatcagttggttcttgttgaacaacacttccagctcacgctggtggttacgcagattgattgcatcttgagattcattagtcatctcggcttccttcattatctggttgaggttgtgttacttcacacgtttgagtgtgttgttttgtcgccagagctttacttgctcagacagacgcttgtgtagcaaataccagtcgtatgtgtattctccaactctcagcaacttctttcgaaagtggttaatccagtactcattatgctcacgtgagtacatcacgcaccctccacaaagtagtcgtattcttcacccaagtagggtttccacttgatgtcgaacatgcagttctttggggcaccaacgaacatcggtgcaatctcagcatccgtataaccagcaaggccacagccaatacgggtgacaaagaagttgagtttgcgtttgccagtagcgaaggccaagaagccagccacgtaggcattgatcatgtccaacggaagagtacgaatgtcctcattcttggttggaatggcaaagctgtcaccgtagtgaccgtaacccttgccataaacagcaccacactttttataagcgtgagctgctgcaccagcaccgtggatgccagcttcattggaaccgaacacgaacactttcttagccattgacttgcttccttggtttggtgacacggatatggaggatttcttggttggggttacagcgagagcagccacaatgcgtgatgctcttgccagtggtacggcagacgactttatacacgtagactccaacggtagtcagggtaggttttggccacggccttgagcagcacatcgctgatcacatgaccgtggcatgcttgtggagtgcagaagcattgcagtttcactggtccatcaatggccagatcagcaatgcgttgcaactcattgatgacagtggtgttgccttggtctatctgctgttgcaaccagacctcgtatttctcaattaccacgtcacgtgtattggcaccttgaatcgggaatggattgcccaatgggctaccacgaccaatgtagatgccagtttcaccatggtgcttgttcaccacacgcaggtgcaggaacttctcaggcctgttgagccatgcctgttgttccttcttggttcgacatttggcacatttgccatctgcaccacagtgcccacgtttacaacgacattgcttgctcatatttacctctaacgaaaccagttattgaggatttgggccagagccacggcttggttgatgctggtgcgagcgaactgatcactgagcttgttgccattctcagtggccttgtcattcaactcggccatcaggtcgaggttgtggattgcccacagttcccacagatgcaggtagtgatccttcagctgtgtctcactccagtcgatgacaggtggcttgcctttgcccagtttccagttggttccaccaatgtcatagcccttgatgtcacactgataccactgttcaatggttcgtccatcaggcatggttgccaccaatgcactgaagcgttgatcaccagcagtactgcactcgtagccaccaccgacgttggcacgcacccagtttgggttgtactcacaggtgctggtgtagatctcaacggtgtcagttgacccgttgaccagcaactcagtcacaagctcgcggccatggttgttgttccagtggaacacttgcaaatcaaaaccagcaccaccttgagagatgatggtgttcagttgctttgcagcttgttggactttcattccagctccctcacaattatgtctagctcgaccacacacacgtcttcaagacgacgatgcttctgtggtctaatgctgatcttgtcgagtacgaagtagcatgggccagaagaatacggatcgtctggtccttcccacccaccatgccctttgtgaatgcccttggcccagctacgcatggcttgggctgcacccttgtagctcttgaagagccgaggtgtcttttcagtgattgggcacaactcagctttggagttgctgcccttcacccatggcagatacagctcgccatgaatggacttgacggcgaacagtttcatgatccctcctatttatctctatcgaggcaatggtacgtggcaacggatggcatggttggccatgccccacgtcattttggttccaccatcagcaggcacatcaccctcgccgaatgtgaaggcaaccatgtgtgtgcattcagcagccaccagtttgttgcgattggccatagctgcataacctttctgcactggttgagtggtgaaggacacactgttgtggctcaaagcctgacggatatggtctatcgaatcgaagcccatcttctggctgaactgcttgtgataccagttacacgctgccccactggttccgtactcgcctttgaagcagtgacgatcaaacggagcaggcagatgtagatgcagttcttttacgagatcagtaccaagtgcccagacggccacatggtcagcccaagcagcaccaccactgacaagaatgtcatcaggttgcagctcttcagccagagtgctagtcatgaactcccaatgagcaggggtcatgggaatggttttgtcacgaccagcagtgccaattacagcaatgattcggctcattggatcagtcctttcagttggcgagtgagtttgaggatctgtttgtcagcttcccatcgtgagtagatgtcagcatgaggcagcccatcgatgtagcggatgcgttgcatgatttgctcagccgtcagggtcttacgcttgaagagatggaacattttgttcctcctatttatctctaagcagcccttgattaggttgagctgtctttagtgaattgggtgtggttttgttctacttaccatttaggttggagtaggatttgttttaacttcggtgatggtgatgttcatgtactggaagccacgcttcagggccatctcattcagctggtagctggcgatgacataggcatggtcacggtcaagtgcatctacttcgatggtcccgttgtagataccactctgccactcaatacggaattgcttgcacagatggagggtgtgttgagctgcttgaggcatcagtctatcggtcatgaatctatcccctttgggagcctatcgaagttaaagcccctagtgcccttgcgggcaccagaggtagagcggttagaacgacagcttcttggcgaaggcgttgttgttcgggtcaacaggtggagcttcttcgtttacacgacgcagctggatttgcaggttgatcaccgaggattcgcccggcttcaggttctgagcgtgggcaaccagttgatcgagcaggtcgttgcgtgcagcttggaactgagcgaagtcggagttgcgggagttggtcttcaggtgatcctgagtgtccaacgggatgccttgaggcaggctgatgaacaggttgttgccgtcgtcgtcttgcacgtcggactcgtaaccgatgttcagccagtactcagctttcggacggtcagcagcaggagtagcagcgttgttggttttgccgaaggttttcggagtgaaatcgatggacatggtgaatctcctaacaatggaatgaatgggcggaattgcccaagagacgcgcagcgtcttagctattgcgagtgcaactttcgtgagctacggagccaactgcaacaatggtcatgagtccaagccagattggcaggtgggagtagaacatagcaccgagagttacaccgatggttactccagcagcgagcagagtcaggatacggaagtacgaagtagtcatgggtttaactccaagtgttgggtaagtcagttgctagcaaggttagagagcgaagtattgcggtgacctcagacaccagacatgcgaaggattgcagcggatacaccagagttgatggcccagattgtgaaggcagcgacagcgattggaaggtagagatagttcatgatttagactcatcttgagggtacacacggatgtgcatacccttgagggtggatttagggttgagcaggagtacgagtagcgttgagtttctccagttgttctggagtacggagtagggactcgaatgccttataagcagactcgtagtggcgagcatggtcagccgacttggacatgaacttctcagccttgagggcagcagtagcacggtgctcagcacgttcctgaatgaggttctcgatgaagtcctctttgtcagcgatgtgacggatgcgttgctcatcagcagccttgactacgaatgcgttgagcatacccactgcaccagtagcagcatccagtgttgtggtaacagtggtagcagcagcctggacagagccaaggacagcaccgaaggtaagacgagtggacatagtggtaactcctagtgattgagggcgaagatgcccaagagtggcgcagccacgcactagcaagctaagtgggggtagggtcgaggtgtagacagtgtaataccgggggggtacttggcctcgtggccggtgtagcggaggtgtacccctcaatggaacatgcctatcaacattttccccatgcaaaaaattttgcagcactacgctgtctatagcaaagatagatctatttaggggaggggctgagcccctttctccttggttctaacgccccaaataaaaagcccccggttcctaaacaggccgggggctagtacatgatcaatccacctaaccggcaatccggctggaacacccgcaggtgctaggagcggtgaacctcatgctgctgctgttacatacccaccttcagctggggctgtgtcaaaaaagcatcgtcgcagtgcaagacataaattagacaagtcctgcattgctgtcaaattctgtttcggtcacccggttcccacgtcgtgtagacggaaccggggtaggtgtccatccggtacttcctcatgccgatgtcttgatccaagaactgaatcttgatctcacacccgtacaccagctgcatggcccagaagaagtcgtactcttcctgagtctccacgagcatgaggttcttgggccgggagtagatttcctcccagtcttccaccttctggtcacaggcaaacttggacgacttccagacttctacgttcatagcaggtgctggatagccgagagctgggcagtggactgcgaccaatgggccttctccctgacgttcttcttccacctgagatcaccctggtaatccatcatgtagtcgaggaaccgggggtcagtgcagaagatcggatggggaccgaggtacgctttcaaggatttctctttgtactggtctggccagtacccatcatgcagctcttggaagtcaacgaggttcacgctgcccaagataagttgcatagagaacaggtaggcccgctcttcgtcacccatggcgacgactttggtgttaggcccccagtcgaacacctgatccaaggtccagaccttgctgtccctgttcaggtcgttgaagtagtagaaatgctcagcggtcatggcgttgtaccgaggtgcagaagtaaattggaagaaggtctgattgtttggtttcgatgaatgtcttgttcccatctaccgacaacccggcgtagtcagttttgcctcgttggttccactcatcccatgtcctgatgtctacctcccgaccgaacatcaactgcatggcagtgaggtagtccttctgctcttgagtatcggtgaggatttggaacctgacgttgtaggtgaaaacaaactcaagggggatggcaaagttaatcaacaccccattgacgtactgcacaagcgtttcgatcattggagactccttagaaatgagttagactaaagggagtctaaaggtcaaccgaccttttatccaccccaaggaacccatcaatggaaaaccaacaccgtctagttaaaggctaccgtgaccttaatcagtccgagatcgacgccatgaacagtatcaagctcgctgagcaggacattggccagctgttccagcagatcaaggccatgcccggcgtggatcaacgtgccatggccttggccaagaccggcttgcaggaagccttccattggttcatccgtgccgtggccaagccgcttgacgtgtacgagctggtgcttccaccggaaaccttcctcgaccgtctcaagcgtgagcgtgacgaaaccgtcgagcgactggacaagctgaagctgttcctcgacagtgagatcttccagacgctgaccccgacccagcaggaagacctgaagttgcaggccgaggtcatgactccctacgccttcatcctgagcaaacgctacgacgatgaagtagccaagcaaggctaagtgaactaaggaggggactacggtccccttctccacaaaaggaataacgaaatgctgaccgtcgatgacgtaagccaagcagtaccagcgaacctcaagtcggcagtcactccgcagttcgtcgccaccatcaacaactgtgtggccgacccggagattgccgaacaggtacggaacaacttcatctcgtttgcctctgtcctgcgtgacggcaagtacaagatgcaggactacctgaacgccgtgacctacgtgtcctacaagatgatggacatgagtaaccacgacgcatggtgctcgaccttcccccaacgccatgcagcactgatcgcagcaggtaagggcaagaaggacatcagctcccacgtctccatgtactcgaagggcaagctcgtcgctgccgtcatggaagccagcttcatccctacttggatcctcaaccgggatatccaacagaaggcgatcaaccgtctggctgacttgatgatgaacgctcagtctgagaaggtgcaggctgaagctgccagctccctgctgactcacttggccaaaccgaaggagtccggcccgctggtgaatatcaacatgaccgagacttccggtatgaacgagatgaaggacatgctggagcgtctcgcttcccagcagcaggaactcattcgtaacggtgtgaccaccaaggaagtggcaggtcagcgtatcttcgagaacgccca

SEQ ID NO: 14 - DNA, 75959 bp, unidentified
  misc_feature 1..11: note = bacteriophages nucleic acid sequence
  source 1..75959: mol_type = genomic DNA
atgaacgtagatccgaaaactggactgatcacccagaagctggatgaatggttggatggtgtggactactcggtgctcaacagtccgagctacatcccatccaccttcgccctgaccttcatgaactggatcaagatggtcaacggtgacgtgggggagagccacaaaactccccctgttcacctgaaaatgctggacaagatcgtggatattaacccgatcaccaaggccgtgaacgcctacatcgccaacctctgcttccggggtgcagccaagacgactctcttcatggagtacttcgtcctgttctgtgcccacttcggctacatcccgaatttcgggaaagtcgaggggatgatctacgtttccgactccatggacaacggagtgaagtcggcccggaagaacatcgagttccgttacaagaacagcgagttcctccagtactggatccctgacgccaccttcactgacaactaccttgagttcaagaaccgtgaaggccacgtccttggctgcaaaatgttcggtgctaagaccggcctccggggtacgaagatcttcggtaagcgtccgaccattgccattctcgatgacctcgtgagtgacgatgactccaagtcgaaggcagccatgcaggcgatcaaggacacggtgtacaagggtgtcaaccacgcactggacccaacgcgacgcaaggtcatcttcaacggtacgcctttcaatgtggacgacatcctcatcgaggcagtcgagtccggtgcatgggacgtgaacgtctggccggtgtgtgaagcattcccctgcaccaaggaagagttcgtgggtgcatgggatgaccgcttcagctacgagtacgtgcaagagcagtatgacatggcagtgaaaaccggcaagctcgcagctttctaccaagagctgatgctccgcattacctcggctgaagagcgactggtacaggacgaagagatcggctggtacgaccgggccgagttgctgaagcacccggagcgttacaacttctacatcaccaccgacttcgccacctctgccaagcagactgccgacgactcggtgattgcgagctgggcctacaacgccaaccgggactggttctgggtggacggcgaggcagagaagcagacgatggagaagacgatcaataccctcttcgcccacgtcctccgttacaaacctcagcaggtgggtatcgaagtcaccggccagcagggtgcgttcatcacttggctccagcaggagcagatgcgtcggaacatctggttcaacttcgccagtgatcagcagggtgggcaacccggcatccggcctgtagcggacaagctggcccgcttcaaccttgtggtcccttggttcaagatgcacaagatctggttcccgaaagagatgaaaggttccaagattgtgggaaaatatctggagcaaatccggctggccacccagtctggtctgaaaggcaaggacgactgcatcgacacgatcagccagctggcctacctcaagccatgggttccatcggaagctgccccgcgaactgaagaggaactgtccatgtggcaggaccagttcagccagcctgaacccaaccgaatggactcctacatcgtctgaggccctatgcaaatcaaagacttgtaccgcaacctctcctacggggtactgaaaaacctcaccatttctggtgaggggagtggtgacatcatcgagaaaggccgggggtctgtgatccttgctgccaatgaggcgttgctgcgtctgtactctcgcttcctcctgcgtgagaaggacgtactgatccgtcaggtggatggggtgaccaactaccatctgctgaagcggtttgccgagttcacagaaccacgggtggaacgacacacctacatcatggacatgggattggagcccttcgaagaagacgtaatcaagatcatcgctgtgtacaatagcgacggttaccagatgccgctgaatgacaacgaagctccatggtcggtgttcactccgcaggcgacggtgctccaagttcccaacccggaaccgggcaaagccttgtcggtcatgtaccaagcacggcacccggtactggaagctgagaagctggatcaacccatcgagctgccagatgttctgcacggtgcgttcttcagctacatcggctaccagatctacaacgacatgggtactgccgagtccatggccaaggccatgaacctgttccagaactacaccttgatctgtgatgaggctgtggcgaacgactccgttcaaaccagcattaccacttccaactcccgctttgaaaaacgaggatgggtataacatgcgtccaccattcgacccagtaggtgggccggacacgctagtagacaagatgctcggcaacgcttacgacaccgtaaaggccgttgccttgaatctggcctacatcaagcacgtatcggaccagctcgaaaacatctacaacgtcagccaagaactggtggcgattcagaatatctccgacaatctggaagatgttcagaagatctacccctttacccaacagatcgcagcagttgctgccgaactggacgaggtggtggctgtctccaacaacctgacccagatccttgtggtctaccaagcactaccgattctgcgtgaacttcacgctgaaatgccggaactgctggagatccacgcgaacctcggtcgtctgattgccgtcttcgatgccttgcctcaaatcaagaacgtcgaatcccagctggcaatgctcaacagcatcaacgacaacctcagcgacttgctggtcatcagtcagaactccagcactctggtgcccatgagtcagaagctcactgagctgctggatatccacagtaacctgacggccattctggctgtgcaggcgaacctgactgctatcaacgcagtggcgactgatatcgccaaggtgaacaacgtctcgaacaacatgacggctgtggctggtgtcagcagcaacatggatgccatcaccaacctcaatgcggacatcgctgctgtggttgccgtgaatgcccagctggctgctatcgagaacgtgaacgccaacatctcggcgatcagtaacgtcaacacgaacttggcctcggtcaacagcgtggctctgaacatgggcagcgtcacgtcggttgctaccaacatggcagacatcaacgccgtggctgatgcaatccctgacctgaaggctgtcctgaagaaggaagtggttgtcggtgcagctgactcggccaccaacatcccgttggctccggccaacattggcaacatcttcggcatttccgggatgctggtgggcactgatgggaacgtgtacttccccgatgcccacttcaactactacgtgtccgggtccaatctggtcgtacagatcaccaccggtgccccatctgcaatggaaggcggtactgcacgggtggtcattcattacgacccaacgtaaggaactgtcatgagcgaccgtccatatgctccactggatgcgttcactcacccacgggaccactcttctcgggtggtccctctctgggtggatgggcacggtccatacgagttggccctgtctgaccatacgatggcattcggtggtcggctggttgataccccttcggacccaatggtcttgaagctaaccaacactggcttccaacctctgaacgtactgtcgatcaccgtcgaaggaccgttcaccatctctggcttcgaaccccatgaggtcaagggaggtggtggtgtttccttggttccagttgtcttccggcccccggcgtttggggtacactacggcaagctggtcattaccacgaaggaaggtctggtcaaggaggtccggctccttggagccgggatttgggactacgtgaaccaagtggaccaagcaatctctgacctgtggtcttttctgcaacgggctacccgtccagcactgactgaatccggtccgatcattgacttgggcaacactggtgtcgagttcaagggagaggtcgctgttggcgaagactccactgacttcgactatgtgatcgccaacgccggtaaccagcccctcatcatcgacaatctcactgtgaccggggacttcgagatcattccatgagcatcactattccagcgtttggttcgcacaccatcaagttgcgattcaagccgacggctgagggggtacgtcagggcaacctgacgttcacttccaatgcaccgtccagtccacacactgtcgccttgcttggctatggcaagtcttcgggtggtgggccagaccctgagccgggcggcaacatcacctacctcactgccgatgggggcaagctgcgagacaacaagggtgagggcaatgttgtaaccctgaagtccatcaactggtatggtcttgagcagatcgggattcctaccggtgcatggacccgcccattccgtaccaaggtggtcaacggtactctgcgtgaaggcatgctcgacgagatcaagcgtttgggcttcaactctatccgtctgctgttctctcaggactgtacgtgggatgggtacgcccctcagactgccaatggcttctggaacacgacgtacatcaacccgaacatgaacggggagttcctgaataaccccactcaagaaaacccccaagcggtcaagtccaccatcgagatcatcgacatcttcgttgcatggtgtgaggaactggagctgcgtgtcatcttcgacatgcacaccctggctccagatgacagtaacgtgctggccaccaacggtaagtggtacaccactgcatcgccgggcctacccggtgcgactgctggacagaaacgggaacctcgtaacgaggctcaagccattgctgcccacgtgttcctcgccaaccgctacaagaaccggccaattgtctgtggtttcgacctcatcaacgaaccgcatgcttgcacgtgggaccgtgaccctttgactggtgtactgggcttctacgagcgttgtggcaaggccatccacgccgtaaaccctgacgtgctcatcatctgtgaaggtgtgaccggcaacgtcgatcagaccccagcaggacacgaaaacgatccagaaagccagcagggcttgtacgactggagcacgtggtgggccggtaagctggatgacgccggtagcctgccggtgcagctcgacatccccaacaaggtggtctactcgccacacgagtacggtgcctacctgatgggtgtggccatgcaaccttggttcaaccctgaagaaaaagtcggtgccggttatgccggtctgcctttcccgcagaacatggctgaagtctggcgtcgtcagtggggttacctcgccgaggacaacattgcacctgtctggattggtgagttcggctcctacctgcgtgttggtggtaacccagttactggtggtggtgctgactactctgagatccatttgcagaaggacgaagcatggctgaccaatctggctgcctactgcgacctgcacaagatcagcttcgcctactgggcatggccaccgggcggtgaccctgacggcctgctgtctcaggaagtgggtggtgcatggactgctgctcagcagttcaaggtggactacctgtccccattcatcactccggtgcctcaagcacaagtgactgcttccccttcgacggttgcctttggtgaacggcagattggtagcagctactcgatgaatctccagctacgtaacatgggcaacactccggtgaacgtggtgtcggtgtcttccggcacgggcttctctgtggtgccgagccatgggactgtgcctgccttgggtgtgctggatctgactgtctcgtttgctgctctgactctgggtgctgccaccggcaagatcaccgtgtcctacggtgtggaccagaccattgaagtcccagtcacggccacctgcgtcaacaaagatgaaccgggcgtggaccctatcgtcatcgacctgccgccgaatgcgtggggcatcactgctgtgggtgactccctgactgaaggtggtgcctacttccacaatggctggctggccaaggcctgcttctacggcaaccagtacctacgcgaccgcaacaacttcgctgtgcccggttccactgtggaacaggcccagacccttcagctgccgaacgttctggcaatgaacccaccaccgaagatgtgcgttgtagcctctggcaccaacagtgtctaccaaggtgcggctggggtggagaagatcaaggagatctgccagaccctcattgctgcgaagatctacccggtcctgtggacgctacctccacgcaatgacaccacgtccatggacagcaacatgattgcgtggaacgacgccatcaaggcctaccaccgtgagactggtatccctctgctggatgcgttcgaagctatgcgtgtaccgggcagcatgcgtgctcaagaagccctgatgaacccggatggtctgcacttctccaactacggctacaccgtgttgggccgctacgccatcgacagcaaggctttcactgctgctcccactgacggacagattgccctgcctacctctgtgggcggaagtaacctcgtccctaatccgttgttcactggttctgctggtgtgtctactggcctgactctggcgactggattcactggtcaattgcttccagctgctgctggtaactggcagcggatcattcgtccggctggcttgactggcaacaacatcaccaacaccattgaactgttcgctattcctgctggcaaatccctgtcccttgcatgcaaggttcgttggaatgctgctggcttgaagggtggggtgaacatggtgcggtcggcatggcaactaggcatgcaggtcatgttcactgaccagagctgggctgacttcccgaactcgctcttcgtagtagtgggtccacaaggtgacgatgtggaagaaggaaccttctacatgcaactgactcccccaactggggcgaatcgactgatggtgcaactggtgtctttgtccaacatggtggaggcccataaccaagacattacgttcgacatctcccagctggctgtggtcgaaggacaatttgctttcaacagcatcgacccaagtccaaatccaacggataatccaaacgcattgcgggactcgtccaacgacatcctgctggattccaactctgaggcaatcgagagctgatatgggcaaactcaatacttaccagctgcaatcgcagctggctgccactctccaactgattggcattattccgggcgaaggctcggctttcgagactgtgcggctgtcgaatgctgcactcgtctccttcatccagcaatacgctggcgaagacggcaatgatggccgtgagatcgaattgcgtgcaggaagcaccgacattgaatggcgttacgccggggccacctcgtggactgccctgatcgccatcaacgacctgaagggtgcagctggtgaacaagtccagttgcaggcgaacgccacgcatatccagtggaagtactcgtctgcttccacgtggaccaaccttgtggcactggccgacctgaaagggaccaacggcaccaatggccggactatgtggtctgtgtctggtgccccatcctcggcactcggtgtggatggtgacttcgctaacgatgccaccaactccatcatgtacggaccaaagacctctggtagttggggtgctggcaccagctacaagggtgcgaaaggcgacactggcaccggcctgaccaaccgtagtgcatgggtttctgggaccgtgtacaaccccggcgactacgtgttctctactggttcggcgactgccagctccatgtggatcctgaacggtgaagtgtcctacacctccaacaccctgccgaaggacgacctgacccactgggtggagtttgttgcaccggctggtgctgatggtgaagacggcaagtccgtggaaatgcgaaagacggccaccgttattcaatggcgtctggtcggtgacccagcgtggactgatcttgtgacgctggcagacctgaagggcgctgacggtaacgatggcaccaatggcaataccgttctgtccaccactggtgctccttcgtctggtctgggtgctgatggcgactttgccaacgacgtgaccaactcggtcatgtacggtcccaagactggtggtgtgtggcctgctggtgtgtcgtacaaaggtgggccgggtgacgctggagctgccggttccaagtggctgactggttctggtgaacctgactccggcactggtgccgatggtgacttctaccttcgtgacacgggtgacgtgtacgggccgaagactgctggtgcatggggtgctgtggtcgcctccttgaagggacccaaaggagacactggtgatggcggtggcggcggttcgggcgatgtgaccaaggcaggcaacaacgccttcactgggaccaactccttttccaaagcagtcaccatgtcccttggtctgaacctgtcaggtgtcttcaactactctgggggctctatggtctacagcggggtatcccgtatcagtggcccaaccaatggtggttcgcttgccctcactaacggtgtatcccaacaagttgtaagcatgtcgggtgacattgcagcagctactatcgtgttcccctctgacaccactgtagggattgagatcactttctatcttgagaaagcgatcactacccctacctacgacggtggtgctatttggggtggtactcagccggtagatgttgttggtgctccggatactcttcgcccaggcggacacaccttccgtttgcttctctctgtgactccagcctggtactacatcaactaacctctagcctgttagacttagcccggtcagttccctgaccgggcttttttattcacagaggaatcctcatggcttctactcttccaccactcatcaccaccgaaggactggtcctcaacaaccagatgccgggtgaaggtgctctgggtaactacacccccaagggcacggcatcgtctgaaggcatctcccttctgatgcgtggcatcctccgggcagcacatgccacgggcgataccactatgaaggagtatgcaaacttcctcttcgatgccgcctgcaagtacttcttcaagggccaacgcccaccggctgaagctggcgaaggctggcatcacagctggatctgcaacggtggtgctgctttccaagtgcgtggtccactggctacttctggtgatctggccttggccgggtacatctatggtcgtgatcctgaatcgtccattcagttcaccaatggggttggccagctgaacccggctccagacatctgctaccaagtggtcagccaagatgctgcttttgtgtggccgaacgtcttctctgatctgactgctggtcagacctatgaggtggactactacatcgactccaagggcaacaaggtgttcggcactcagaagggtggctcctttggtcaaccctccattcctgctggtcagcacgatgatggtgctccgggcaagatcgtcctgaagactcctgtctccggcaccctcggtgtcaacttcaacgtcacggttcctgacgtggttgtggcttatggtgagctgtatgaagcatggcccatgtggcggaagctggcagatgaggaagtctcgacggcagctgatgctatccactggttcatcgacgcattccagcttggtcgttccttggatccagccaactccgactggaccaacgccctcaaccgtatgcaggaagtctgggaaaccacctgcaaccaagagtccaacagcaccttgatttttaaggccggagcagacggtccgtacaataatttcccgcttacttacagctatggctatggccgggacaacatcgacaacagcagcaccaattgggatgccgtaccccccactgatcgttacagcgtgcaacgggaaagcgatggctacgtgacctttgtcatgcccaaggaagatgctgaagctgggacgggcctgccaattcgctatggtatcgccttcgaaaacaagccgttgtatctggagtacacgcaaaacagcacgctcgtcttggacagttactcctcggtggctcagacgttggacgtggtgattggtgatgccactgacaagcagtacacggccactgtgttgctgggtactgttcctgatacgccagtagaaattggtgttagtcagttcctgcaattccagcaacaacctggggatgcatcgggtacgcagaccggtgactggcatggtgacgaggacttcgttatgccagtgtacgatccggtgccgtggccgggtcgtcgtatggctaccgtgggtgactcgatcactttctataactgtgcccatatcgaccccaaggctggctccaaccgctatgaaaactatggctatggatatgctggctggtgggtcaatgctgaacaaatcatgcgtggccggaccatgctggaacatggtattcagcctaatctgactggtaagcaccggggcaccagctttgctgtggccggaaccaaggtgcagaactggtggttggcacaggacttcccagcctcgcccaacactccagaagtggggccgatgtacgctgccctacagtacctcaacaagtacgacatggtggccatgcttggaggcaccaacgacctgtcgggtaatgccccggccctgcatgtgctgaaccgactgaagcgtgcttcgaccgatctggccaagaatggtaagtgggtgttcctcggagtgatccctccacgcactcggtgggaactgcgagggtacacctacattgagcagactcagattctggaacgattgaaggaagtgaaccaagggctgcgtgactgggttgccaacgatcgtccaccgaatatcttcctcgtagactggtacgaccgtctgcttggaccgaacggccaagatcctgctggtctgcaatcccatgcctctgacccaaatggtcttgactcgctgggcaactaccgtgcagatgcccctaacttggtgttcttccacgatgggctacatcccggtccagctggcgctcggatcatgggtgaagtgctggctgaggttatgattgctgccggtgttccagcaagggacaacaacaacacccttgggcctttgaccctcggtccaaacttgttgtcgaatccgactttcggtttcacctcgtttgacaccaccatcaacaccagcaactacaatcagtctgatatcggatgggcttacggtttgggccaacaggtcaaagtgggcacgctccacaacggcttcacgtatggcaaagtaccaaacaactggaagttctttaaggccaccaatcgtgaaaatgtacctattggtaatggtgttgggggtgtctacgccaacttcatgagctacacgtatggtgatatggcggctgagttcccggctattgtgccttacatggctgacccaacttggcctgaaggctcagtgcgagtaactcttggggtacatgggggttcgccagctctgatcatagacgttgatatgcctgtgacgggtaacaagaatgagtctttcgtgttggtggctgacatccctcgccgtcaacatgggccatgggataactacggttacaatgggcctgaccaaaacatggtagtcatcaacaccacgtatttccccggagatatgctgttggttgagtctgacattgtatttgaaaacctcaatgccactctgcatagctgccaacaggtgctctacttctaccagaacaacccaggtatttcctttggttctaagctggcatcgttcggcaaccacccgttcatgtatccaccttcggacatggacaagatccggttgcacactaagaaccggacgatacaactgcgttccccggcgatccgggttccacagacagaggcgggtgaaaccatgcagtatgctgaactgcggtatgagattggcttcgatgcctcagtcatgggtccgaaagggcgaatcatcatcaagaacccttccgtgcggaaggtcaccggaggtactccactttgacggcctataacgtatggctgcccagtgacaaattttttggctacaacaacggggtacaaacctcgttgtcgtaccagagcactggcggaagtaacaaactgctgtgccgtagcttcaccattccagacttcgagtctggttttgggatcacctacgaccagatcaatccggcttttgctatcactaagccgcccaagatctgttatagctcgacggctgacatgaccctagcaatcaaggatagcgatggctggctatggacggcgaatatgcctgctcaggctgtggtcaaggaacgaggctgggcatggagccagttcatccttggttctgtacaggaaaacaccggggaacctccagtgtccccggcgactggcaacatcttggccttccagattagtggggccagcggttcccatggaccttctgggaccgacccagtcaccgtgcgactggcttatgtggccgggcgtactccgggcgtagcttcagcaggcaccattcgccaagtagtgttgaccgacaagaacccagcagcccatacatggaaggtgggaaacatggaactggtcaacggctctcgtcgggaagtgaagtacatcggtgctctgccattcggcctgcaaatgaacggtccccgtaatcgtctgtcgtcgttgccgtaccgtggccctatcgtggctggttaccagtcgggtacgccatgggtgcatgagaacaacaacgaaggattgagcggcatgctggacttcatgctggattcccagttgcagttcactgcccggagtccccagcgtctggtcggtccgttcatgcacatctacctgcaagccctctgggactgtgagcagaacggtgagatcgacacgtgggtgtgggatggcccagacggtaaccctgcatgggatggctggcagtaccgggcaatcgactccatgggccgtacttggtacgagatgagcctcaacccacagatgtcggctgagaacatggagaagatcgagatgatctgtacccagttcctcgactggctgtatcagtggttcatcgaccacgaggaagcaaacggtgttcccaacgactggcgaccaccaaactggacccaagggaacccaatgcctgcgtccagctacctcgatccgaagtacactggcccgtctgcccatgacgatgcactggcactgaaaggtgctctgttctctctgcttgctggttacaacagcctgaagggtcgctacatcgttcaccgtaccttgtcggctctgctgagtctgcaatactctggtgaggatgagatggatggggcattcactcagaacccaacgggctacgaggtctatggctttgaacagggagagatcttggaggctctggctttggccaaacagcacccggaactgctcagttccccgatgactgtcactgagtagcactttgatattgaggggatttacgcaataatcccctcggttttacttataaggaaaatccgacatgaccggggagtcgcttgaggtaaagatcgcccgactcgatgaacgtctccagcgtttgcttgacgagtccgagcttgctcgggaggggcgaaagcagcagtacgagaagctggagcaagtgaaccagacggttacccaactggagtctcgggtaaagggagtggaggatgggctgaccaaggcatcccccaccattgatgagttcgttaacatcaagatgaaagtccaaggtgctggcattgtcggcaagtgggtttgggctgcgggtggcactcttctgggtgctctggctgtaggccgtgaggccatctttgcttggttttccaagtgatccggccaatcgagaactggagaaaggcatggaagtttgcttcagttcagtggaatgttgttggtatcctgtgcatgctgctcgaaattgtgcagcagacatggcaatcgctacccccggcgattgctgagcagattcccaattcgtctcacgtagccttggtcttgtttcttctagctacggtggggcgactcatcaagctgaaggaaaaacaggatggctcttcctaagaagacactaggtgcagcaacggcagcaatcctcgctgccgtttttgctatggaaggtggttacgtcaacgatcccaaggatcccggtggcgaaaccaaccatggcatcaccatcgccgtggcccgagacttcgggtacaccggtcccatgcgtgacctctccaaggagacggccaccaacatctacgtcaccaactacatcaacaagccgggctacggtgagatcatcacgctctctccggcagtcggtcagaagatcgtggatgctggggtgaacaccggcacctcccgttcttcccgttggttccagcaaagcctcaactacctgtcgcgtggtggggtcgatttccctcaaattaatgtcgatggtaagatcggccccggatccattgcagcgtaccggtcgcttcaatcggtgcgtggaaaagtcaaagcctgtgagctggtcctcaaactgatggatgctcaacaggccagtcactacatgagcctgaccaagaccccacagtatgtgccgggctgggttgaccaccgggtaggcaacgtcccattggagaagtgcaaggaatgaacctgaccaacatcttctacgctggtgtcctcgctgctgccattgctggctcctatgccctgactttcaagtacgggcattttgtaggcagcatggaggtgttgaccgagtggaacgaggcgaatgttgagcgtgcaaaagcagatgccgagttccaaaaagaaaatgctgccttgatggcagcacatatcactaaacagaaagagctggaggaacaacttgatgagcaaggtcttcacttcgaaagcatgctcgatgctgctcgcagcgactttgctagccggttgcagctcgcagaaggccgagcgggagtatatcaacgacaagcccaaggcagccgtgctgagcaaatccgccttgcagagcatgcagccgaactcgaccgatctcttgaacagggccgggctctggtacgagaactcggggaaactgttagacagcgtgaccgaaccatcggcatcctccgagaagtaatcatcaacgaccgcaccctcactggtgaacagtaatgagccttgaccttgaacaacgagtggatggcaacgagttgccgaagctcactgactgggtgaatgaacccagtctgcgtgacttgaagttggacttcgagaacgcccaacagaaccactcgaaccagatggccaagatcgacaagtgggtcgagctgatgaaggtcaccggtgcgagcaagcctcagaaagtcaaaggccgttctggcgtgcagcccaagctgatccagcgtcaggccgagtggcgatactctgccctgagtgagcctttccttggttccaacaagatcgccaaggtgaccccggttaccttcgaagacaccgatgctgcaaagcagaacgagctgctgctgaactggcagttccgtaccaagctcaaccgggtcaagctgatcgacgacttcgtgcgtactgtcgtggatgagggtacttgcatcttgcgtactggctggcgtcggcacatggtcactgtggaggtggaacaaccagtctacgcacattacgagatccagaccgaagagcaacttcaggccttccaacaggcctacgagctgtctgaggaaaaccctcgtggattcgatgaggacgtggacccagcactgaaagaggcagtcacctacttcaaggagacgggcattgccacttatgcagtgcaggttggtactcaaatggtgccaacccagaaggctctggagaacaagccattggtggacatcctcaacccacgtaacgtggtgtttgacccgtcctgccaaggtgatgtcgaaaaggccaacttcgctgtcgtctcgttcgaaacgaacaaggctgagctgctgaaggaagggcagcgttacaagaacctcgactacgtgaactgggaaggcaacaccccggtcactgccaacgactacgcaaccactaccccggattccttcaacttcaaggattcgatgcggaagaaggtcgtggcctacgagtactggggtttctacgatgtgaacaacgatggccgtctggttccgttcgttgccacttggatcgggaacgtcctgatccgcatggagttgaacccgtaccctgacgagaagctgccgttcgttgtggtcacctaccgtccggtcaaacgtgatctgtacggtgagccggatgctgaactgctggaagaccaacagaacattctcggtgccgtgacccgttcgatgattgacctcttgggtcggtcggccaacggtcagcaaggctttgccaagggcatgctcgatcccctgaaccgtcgtcgttacgataacggacaagactacgagttcaacccgaaccagaaccctgccaacaacctcatcgagcacaaggctcccgagctgccacagtcggccttgaccatgatgaccatgcagaacaacgaagctgaatccctcactggggtgaaagcattcgctggtggtgtgtcgggtgaggcctacggtgatgtggctgctggtatccgtggtgctctggatgctgcatccaagcgtgagatggcgatccttcgtcgtctggccaaaggcatggctgatgtcttcaacaagatcatcgccatgaacgcagtcttcctcagtgaagaagaagtcgtccgtgtcaccaataaagagttcgtcactgtcaaacgtgaagacctccaaggcaacttcgaccttgaagtggatatctccactgctgaggtggataaccagaagtcgcaagatctggccttcatgctccagaccattggcccgaacggcgatccgaagatggtgctgctcattctggccgagattgctgacctcaagcgtatgcctgagttggctcagatgctccgtacctacgagcctcagcctaccccggaacagcagatgctccagcagttggagatcgagaacaagcaactcgaaaacgagaagctcaagtccgagatcgcactgaaccaagcacgagcacaacgtgagctggctatgaaagaacaggctgacctcgactacgttgagcaagaaaccggtactgcacacgagcgtgagatggacaaacaacgtgcccagtcgcagggtaaccagaacctgcaagtaactaaggcactgactactccacagaaggaaggtgagaagcagcctgacctgaatgctgctatcggattcaacgctattagttctaagttgaacgacgaacagccttcgagtactattcaacggaatgactctggcagccgacctaccaatttggggagcagccagttcaatccagccgtagatccggcactcaacccagccattggcatttaattcaaggaccaatcagacatgtctgaagtcgaacagaatatcgaagaactccaccagtacaaacgtgagcaacagactctggtcgatgctcgtgatcaggccattcgcctgagcaccaacccggacttcaagaagctgattctcgaaggcttctgtaccagtgaagccgcacgttatgcacaggagtcgggcgatccccagctgactgccgtccagcgtcaggatgccctgaacatggcacaggcttcgggccacctgaagcgtttcctttcgatgatcgtcgtcatgggtaacactgctgcccgtaacatccagcaagcggatgacgagatcgcccatgtcacggagggtggtgagtaatggacaagtccactgacattctcgaaatgtcggacgaggacttcgccaagctggcccctccagcagtaacggaggctccggcctccgaacctgctccggccactgaagaacagcaagcagctccggctgctgctgctgtcgaagctcctgtccagaccgaagaacaacagcctgctgctgctactgaagaagagcagcagactgaagagcaacagcaacaggccgaagaacagcaacaagctgctccggtcgtcgaaggcgaacagcaacctgctgccaagcctgatgctgctgagcaacaaccggctgccgaagagttcgactacaaggctgcctacgagaacctgctggccaagccgctcaaagcgaatggcaaagagatcaagctcaactctatcgatgagctggtccagttggctcaacagggtgctaactacacccgcaagatgcaggaactcgcccctcaccgtaagactctcctgatgctggagaacaacggtgtcgatgctgaaaagttggacttcctgatcgccctgtcgaagaaagacccggcagcgatccagaagtacctgaaagactccggcgtcaatcctttggatattgatgtcgaagctgaggcgacctaccaaggtggcaatcaccgggtcagtgacgaagaggctgctttcgccaacacgctcgaagacatgcaaatgtctgaggctggcaagtatgtcctccagtcgattcacggcacgtgggatcaggccagtaaggaactgctcgtcacccaacccaacatcatggagatcatgcgtcagcaacacgaggccggtttctacgaccgtatcgcggctgaggtggatcgccagcgtatgctgggtgcaattcctgccagtcaaagctggctgcaaagctacaagctcatcggcgacaagatggttgagcaaggtttgtttgcagatttgcttgcaaaacaagagcctgctgctcaaactccccctgtcgcagctgctcctgtggccacccgtgtagctgcaccaaagccgactgtcactgctgatgctcgtgctgcggctgctgctccaactcgtgctgcaccgtctgctgctaagaagctcgtaaatccgctcgccatgagcgacgacgagttcatgaagcaattcgaaaaccgtctctaagtaagggaagccccagatgctgaactataacgctccatcggaaggccaacagtcttccatcgaaggtgctggctccagccagatgaacaccttcttctggctgaagaaagcgatcatcgaagctcgcaaagatcagtacttcatgccgctgtcgtccaccctcgacctgccgaagcactacggcaaggaagttcgcgtctaccagtggatcccactgctcgacgaccgtaacgtcaacgaccagggcatcgatgccaacggtgtcaccatcgtcaacggtaacctgtacggttccagccgtgacgtgggcaccatcgtcagcaagctgcctgctctgaccgagaacggtggccgggtcaaccgtgtcggcttcacccgtctgcaacggaaaggctcgatccaccagttcggtgtgttctacgagttcaccaaagagtcgatggacttcgactccgaggacaacgtgaaagagcacctgagccgtgagctgatgaacggtgccgtccagctgaccgaagcggtccttcagaaagacctgctggctgctgccggtactgtcctgttcgccggtgctgccacctccgatgccaccatcactggtgaagtcaccccagaagttccgggcacttcccctgaaatcccggcctcggttgtcagctacaagaacctgatgcgtctggacaagatcctgaccgacaaccgtaccccgaagcagaccaagatcatctcgggttcccgcaacatcgacacccgtgtcatctccggtggccgtgtcatgttcgtcagctccgagctggcctccaccctgaagggcatgaaagacctgttcggcaacaaggccttcatcgagccgcagcactacgccgatgctggtactctgctgaacggcgagatcggttcggtcgatgccttccgcttcatccaagtgcccgaaatgctgcactgggctggtgctggtgccccggtcaccgataaccccggctaccactcgaccaacgtcggtggcaccgagcgttacgacgtgttcccgatgctggtagtcggcgacgactccttccagaccatcggcttccagaccgacggcaaaaccgtcaagttctccgtcatcaccaagatgccgggcaacgaaaccgctgaccgcaacgacccttacggtctgaccggcttcagctccatccgctggtactacggtatcctcgtcaagcgtcctgagcgtatcgctctgatcaagaccgtggccccgatctaatcgaccacaccactgaccgagggggagtgttccccctctggttccaacactccttaccggaactgaaaccatgagcgtagttaccaaccctctcgacaataacgaagacgacctgaagatgccttccgaactggaagtactgaaggaacgtgccaagctgctgggcatcacccacagcaacaacatcaccgtcgaaacccttcgcaagaagatcgaagaaaaactggccggtgagccggaacagcctgctactccagtggctcccctgaccgcacctgtcagcgaagaagctgctgccgagatggcagccaatgcttccgaggccttggcccaagccgaagcaccggctccgaccaagacccctaccctgcgtaattacctgctggccgaggccaccaagctgatccgtatccgcatcaactgcatggatccgaagaagcaagacctgcccggtgaattcttcaccgtggccaacgaacacatcggcaccgtgcgtaagtacgtgccttttggcgagcagaccgatggtggctaccatgtcccggcctgcattctggacatgctgcgtacccgtgagttcctgtcgatcaccaccaccactcacccggtgaccaaggcgatcactaccaagactcgctacgtcaaggagttcgccatcgaggttctgcctccactgaccccggctgaactcaagcagctggctgctgaccaatcggcctcgggccgtttggaagaccgcgactaaaacttagctcgcatacggaaggcccggctatggtttaatagtcgggcctttttcatttgaaccaagaggaaaccctatgagctgcggagctgataacgttgccaatggcctgatcacctctctgcttgcgggtgagtcgttcgacatcccgactgtggacttcaccaagccggagttccagttcccgtatgacccggacagcccactctacatgcagatcactccggtcacgctgtcggacctgactacccgtacaccgggtggggatggtgcgttcgatgcactgatggatgctttccgtctccacctccgtgaggaaatggagaagggccgtatcactggtgccgagtacaccaaggcgtacactgccctcgctgacgctgccatgaaccaagcggctgcattcttgctcggcaaggatcagtccttctggcaggcacagtcggcacagattcaggcaatgactgctcgaatcgacatggagactgccaaggtacgactggcatccatgcagctggaggcccagaccaacaaggcccagttcgcctcgaccaagatggacttggccaccaaggacgttgagtactgcattgcccagtacaacctgtctgccatcatgccagcccaactggtcactgctgagctgcaacaagctggtgctcgcattgccaacgacactgccacctacaacttgaacaccatgatgccgttgaaccgggacatgctgaccaagcaggtggatggtcagaacatccagaacaacacggcttccttcaatctgtcggacatgatcccgcagcaactgaagaaccttcaggctcaagagcgtctgctcaaggagcagatggaagcccagcgtggccagacctcggatgtccgtaccgacaacttcccgattgccggtgttcaaggcaagcagaaagagctgtatgcacagcaggtcatcagctaccagcgtgatgctgaagtgaaggctgccaagatcttctcggatgcttggatcactcagaagaccatcgacgagggtctgctggctccgactgcgtttgccaacgcttcggtcaacgaagtgctctacaacatcaaatcgaagaacggcctggggacggtctaatgggctggtttagcaagaagaaaaagatctacgtctcttccgtcacctacaaccttgcaggtgatgagaaggatcatgttcgttatgtgccaactacggtgctctccaagatcatctcgaacagccagttcgatatgggtgagacgctccgtggttccttgattcgtgggccgggtatgcgtatgcgtacctttggcaaatgggctcgggatactggctattcttctgctatcagccttcagactggccgtcttcgtggttccgctgctatcgatacgggtgtgctcgctagcaccattgagcacgcccctgatcaagaggtgctggtggattatgccgaggtggccatggctgactacagctattgggctgagcaatggatggctgagaaccacccggcagaaatgatggaggacttcgaactggatttcaaagaagacatcaacaccatctttatcaccttccctgatgggcgaggctacggcttccagcctgtgaactttgatccgttgtcccagtacctgtttgcggcctacaccctagtgtccaccccagagccgtccgaccctgagtgggaggcacctgttgtggtcgctggttccggtgacttccctccaaccatgggctggacggtggagagcaacacctccactactggtgtcatgaacgtgaacaccaccgtcactgctgtctctactttcagtgatggccgtcctgctcagacggtgaccacggttacgccgggcactgccgggtacacgaaccaagaggtcacctactcgcaggagtactacgacggttcaggtactgagggcgaggatgagttggtcaatatcaagacccttcagcagaacatgcggaatgctgtggttgtttcgtcgtcctcgtctgacacctccactgaaaccattggaggtggtgtaatcaagaccacggttacgactacgactgttgagacgctggccgatgagttcagctaccgggaaggtactcagcgtgtggtaactaaacgctggtctgcccgtaagaccttgatctacaagtacaacactggccgtcctgagtacgacgccatgtttggtgccaccagagacactggtgtgtatttcccctttctgcccattcgtcagaacgagcagatgatcagtcctacctactatgactctatctacgacctgaacctcaaggcttacccaaaggcttttggtaggaatgccaagtacacagaactcattgacaatttgaacagtaacagctcgattggtgacgtagaccacgggttcgttatcttcggtgtggccgtcaacaccaaaaacacttcggcactgaaatacatctacaagtactttcaggccctactggctcagggaggaggaggtactggctacgacgcatggaaggctctatggaacttggccgatatccgggccagggcttgggtgagttggcgtgaagcccagtcggatccaaacagtcctctgtttggagctgatgagccaccaaagggtgtttacccagcagccccgatcacctcggtccaagtctactcggatgtcttcaactacaacatgatcgtctcgtggagttcgatgaccgaggtgaccggggttggattgggtaggcccggtgccaaggtgggggatgtctggtggaccattggtgccagtgagactttcaacgagatcgtttactccggtggggtagctggtgtggccccatcctcctacagcaccgtgctgctcacttggcaggatggggtgaacacattccgtactatccgcaccactggtctgcaccataccaacatcgtctacaagggtaagggagtggaccacagtatcagtgcgtccattcaggaaggtgacgtaaccggcttcgtgatccctctgcatgaaggtgtctttcgtgccatgtcccttgtggaccagacggagatgagccagtccaatgcctacttggttctcaacagctacgaggttgtgaagcagaagtggtatcagactggcttgttcaaagtgatccttgtgatcatcatcattgtcatcagcatctttacctacggtgcaggtgctggggtcggtgcaggtctgctgggtacagcagcatccgtaggtgctgcccttggattcaccgggatgatggccattatcgttggttctattgccaacgctttggctgcaatgattttgtcccagatcatcatgatgggtgccaccgccctgttcggtgacaagatcggtgccatcatcggtacgattgcctctattgtggcagtctcctacgggactagcatggcctctggacaaggcactgctggggcactcaacaacctgatgtccgctgagaatgttctgaagctcacagtcgctgccggtgaaggcattgcgtcgttcatcaacgacgacactgctgacatcatgaagcagacccaagaggtgatcgacgactacaaccgggagatgggctacatcaacgatgagtggtacaagaacctcggctacgggaacatcctgttcgacccaatgcagctgactgacattggcaagcaggacttctaccccgaaagccgggacatgttcctgagccgcacattgctcactggttccgagatcgctgagattacgaactctctcctgtccaactacaccagtgttagtattagcactgaactaccaatgtaacggaggcctcatggctaatgtccaacaacaaagccagttcggtgtgcttgaccaactgggtgcaatgctcggcttgggggatgatggcattcgggaaactatgaccattcccactgccctgaacaccagcagtaactggtcccctccgggctcgatctctaccccggtcaccactgctggagcaggtggtggtctgggcaccggccttggcttcaacgtcggcacgggccaactggcactcggcgggctgtctgctctggctggtatctggggtgctatgcagtccaacaagctggcgaaggaacagttcaaattccagaaggagttcgctaataccaacttgaacaatcagatcaagtcgtacaacacggctctggaagatcggctgaatgctcgtggtgttatggagggtcgtgatcctgcctatactgctgctgaaatcgaccgtcgtcgcctgagccggtaaggagaacccaccatggctgcattgacttggcgagacgttgctgttcctagctttgctggggtcaacgaatcgtatcgtactgctggtgctcagatgcaacaggcccttgcgggtctggctgacgggctcaagcagttccaagcccagcgtcaagctggtatcgacgctggcatcctcggtcgggccatgcagatccaagaccctgctcagatgcgagaggctttggcttctggctccctgttgcagggtgtggacctgtccaaggtcaatccgaagattctggctcagttggatgagcgtaccggtgccctgctccgtaacgctgccactgaacagaacatcgccagctccaaactgggtgacaagcgtacccaacagaccatcgaccagtctgactacacgcacaatcgaaccgtgcaggagaacgccaacgaggatgctgctcgtggtcaactggctcagcagttgggtttgactggcccattggcaaatctgtccaccaaggatcagcagaatgttgcttcgacccaatcgactctggctacccagcgtctgggccgggctgctactgcactgggcatggaccagacccgacagaacatgagccagtcggccaccaacttcaacaacgctcagatcgaccggaatgagcaacgtgaggcactgaccacggctgacaacatcacccgacagtcggctagtgtggaagacgctcgtgcgaatctagatgacatgactgatcagtccccagtggttcgtgctcgtgtgaatgccctgctgaccaataccttcggcaacctgtatgcacctattgacggtgcaactactggtggcaaagctggtgttggttcgggtgccccatctgatgggactgctaccccttcggctcaagctgctgaagctctggccttgaatgctcgccgtgtggcacagaacagttctccgggtgtagtggctgacatcgagcggaccatcggtgatacccgtagtgttggagaggtcgcccaagagattgccaagctgatccctgaagctgatattggcaagatcattggccgactggccaaagccaagtcggacaaccccgacctgtctgctgctgaggtgggtgctgcaatgacccgctctctgcgtgatgcaggcttcttcactccggggaccacttcgctgggtgagggtgcaggctacgacgacggggcgttcactgccaacctgaaggatcttcgtagtggtaaggctgactaccaatcggctggtaatcgccaggtgcgtgcagtgggcactgcgatcaagaatgctgacgctgccttgaccaaagccaagcaggaactgctacaggtccagcgtcgtgcccaaacccagtcgggtgtagacaccagtcgctatcaagagcgtgtggatcgtgcccaacagaagctgaacgatgccatcgagaagcagacgagcaacccggacttcatgcctaacgtgctggaagtggttccggtgccagtgcctcgacaggctgttcatcctttcccactcgggtaacataagaagccccagcagaaatgctggggctttttgattttacatggtaaagtcttcctcaaacttatccttagataggaccgttcatggctaacccactcgacctgcttgcacaagcagctcaaggcgtccagatgatgccggaagagcctcagttcccgaatctccgcaatgacatccccggtgacttcagtcaaccggctactattgctcgggccaatacccctgcacctgtccatgacgagcttgttcctcagcaacaggcacaggcagtcaattgggcagccgaggctgcacaaaggactcctgttcggagcaagatgatctctctggatcgtatcagccagtccaagcaatcgtccgttgctcaggcagctgctgccaagcaatcgttcatggctccacaggattactttctgaacgctgtaggtgcagacactgacaaaggccgtgacactgccactgaggtagaacgtgacctgcgtgacctgaaccctctccagatcctccagaagtatggtgacgaagaaggttcccggttgatcgccggtcaagctcgtggctatggccagttgacccaagcggacactgcccttgcccgtaacaagaccgagctacaggatgacctgattatcaacttcggccaaggtgttggtggtgctctgggtgggttgggtgctttcggtctgggcctcatcagcgatactgctggtacttacgctgccgagaaagttggtcagttcaacaagttcatggaagggatccagtcgcctcgccttcaagcacgtcaaggtgtgaagcaagccaaagacgcactggatagccgcgactctgctgcccaagccgtcaaggatgctgctgagtatggtgatgctgttgctggcctgaagcgtattggtcgtgacgttctgtcgtccctgtccaacgcaactgacgaccctgccactctgggtgctggtatcacccaggcagctggctcgttcgtggctgctggtcctgtggctaaaggcctgtctgccctatcggggggtgcgctcggcaccactacggctatcgctgccactgaagctggtggtgcatacactcaatcggctgaccagatcatgagccgtacccatgagcagctgatggaaggctctcagtactaccgtaccctgatcgagcaaggcgcctcgcaggaagatgccaagcgtgctactgctaacagtgtcggtctgactgctgctgctattactgccccggttgcggctgctgccggtcgtctggtgcatcgttttgaaggcaatgtcggagcccttggttccggtcgtcagttggctgacaacgtcattcgtgaaaccgcagaagagtccatccagtccggctttagccagttcgctcagaacgtggcaacccaacagatcgcagacgacaagcaggctctgaccgaaggcgtcggccaacagatcgctgaaggtggtctgtacggcatgggtatgactgctgcactgggtgctccatccgtagctcgtgatgctgctgcggctggtggccgggctgtggcttctgccttcaatgaccgtctggctcgtatcgacgaagccaacaaagcgtcctcgcctgtgtccgacgaaactgtcgctcaggctgctgccgaggctcaagcgtctgctcctgttgctgagcaagtcctgcgtgaagccgttgcttctgctcctgctgaacagcaagaagctggcaatgcctacgtggaccagttgctggctgcatctcagttcagccctgacgaagcccctgctgctttcaacggtctgttcgatgacgtgaccactcgcaccggtgcgatccagcgtatggctgagatcgtgaactcggctgaggaaggttcgaacgaccagctgcgtgctggcttcgctctgtacgatttggtcaacgattacgctgctgccatcaaccaagatcctgacgctctgtcggctctgcctgctgataaccaagcagcacagatcgtggctcagtaccaaggcctgatgggtgctatccagaactccccgaaggttgctggtgcaatcgacaaggtgatgtccctgctcgaagcctccgaggccaagcaggttgacgtgactgctgaatcggtgaccacgcctgaaggccagcaggaagtagcggacgtgctgtccactgctgaactggcccctgagaaagttgatttgggtactgctgagaagatcctgttccagattcagcaaggcaacctgacggtcactccacgtcaaaaggctgccttggattcgtctgtggcgatcctacgtgcggtgcaggaagctgacaaagcggcgatagcagctggtcaggcggacccagtgagcctcaatatcagcacggtagacggtgagaaagggaagtcgctgacacaacatgccaagggcatcatgtcggcgtggaaggcgggtgaccgtgatctcgcagctgaccgacttgtcgatttgaagaacttcgctcaaggcatgagcaataaggtcggggctctgaatgcccactttgctgcgggcaagccgaatgctgagggactgcactacgaggtgttcgttggtggagaggctgtgccctccaaagccaaagtggctacccgtactggtagccaaggtggcatccagtttgctcagaaagtcgctcgtgaggcgaaacttctggctgatgtttacaacggtcttgcgaccgcattcccagatcttggagctgaacatttggcggtaaccccgctggcaagtgaattggtcggcaagcctgctgaggttgtagcacgtctcaaaccccaagctgccccggtcgttgaggtgaaggataccccagctccacaagctgcacccgctcctaaaaaagaatctgccccagctgcgaaacccaccgcatctgtggttgagaaaaagcaggcacctgttcaaaaagtagctgaacgtgtagtggaagaagcaccagttgtcgccgaaccggctccagcactgaagggaactgctgctgcattccctcaactgatcggtggcgagtccaactacttcaaccgctcgttcaagctgcccaaggaacagcgtactcgcaccatgggtactgaggcacccgtggccactgtccgtgctgcactcaaggactctgcttccctgactgctgccattggttccttcaagggcaaatacacccctgagatcgccaaggcctacgacagctaccttgccgtggctgaagacttcgtttccgaactggatgacactcttcagcaatatctcgattctccgtacagcaaatccaacccgaccactattcgggagatcgttgacggtgccgaggttcgcacgggccaaggtgagctgttcgagcctgctcgttctctgcaaggccgtgttctctccattgcggagcgagatggcaatgacgtggtgtacaaccccgagttggcccaatcggcagtgctcgccgggttgcagtggttcctgaccagtgacaactacgccagtgagcaagacaccacggacatcgccaagctgcttggcatggaagaggcgtctgtctccgacgagatcgtacaggccctgaaccaagggctcagtgtgaccgaggccaagcgttcgcttgccacgaagatccgccagtactggggcgtccagaacgaagccgatgccggtatcggttatcaggaaggtattccagaagcggttgcagccgaagtgctgcgtgcattcgtgaagggtggctggctgactgaagagacggtggagctgaccgaagctgatggtctgcctgctctccctgacggcaagccgaacgtgaagacctttatccagttggtcccttccgagatcccagctgactccccgctgcgtgcattcccttcggcaatcgaacaggctgtcctgatcgaaccgcaggagatgaacttcatcggtgaaggcagtctgcctccggtagctaaggatcagttgcgtaaccccggtgtgaagaacactgcccagcaactcgccatgatcgagaaagagcaggcaactccttacaacgtgaacacgcacatggctggtttctacactgcccttggccgggacaatgtgctctcgctgttcggtgctggtgaggttgatccgaagaccaccaacgtgaaccacgctcaatccatggaaggtgtgaaccgttccgtggtggctgcgttcgaccacctgcaaagcctgctggctgaggtggacaatatcggtgacctcgctaccacccctatccactaccagttcaacatgactcgggttgctcgtctccagatgctgggcaagtacaaccctcagtccaacaagctggtacgtgaggcgatcctcccaaccttcgccaccgtggacctgtccagccaaactggtcaggactacaagcggttcatgctggctgtcggccagatgctgggcgtgaaggtccacaagatgtcccagtcccgcagccgtgctgcaactgaggccatgctgactggtcctctggctccagcggttgaggctctcgccaatttctccaagggcttccgtgacagcgacgtgctggcaccttctgccacgttggacaatgccaccgtcgagatcttgaaggatgccttcaaggcctctggcgaagcactgaccccgatggcactgcatgctgtcatggactacgcccgttacctgaatgctgaggacaagtcggcgttccgtactgctgtgtacgtcgaagctgacggtgtgaccaacggcccgatcaacgcaatggtgctgttcaccactggcctgttcaaaggtaactggatcaagaacatcgccaagggtggtctgttcttcaaccgtccgggcgaaactgtgaataccaacaacgagtcgggtgattcccgtgacctgtaccaggccactactgactcgctggatggcaagctgaacaacctgcgtaaagtcctgcgtgacgatgccaagggcacccagcaaatggacgccatgctgcgtctgatggatctgttctacggcaaagacctgaccttccgtgaggaagagggacaggacgccaagctggaattggcccgtggtatcgccaagaacccgctgacgatcaccatctacggctccggtgcaggcggtatcgctgccaagatgaccaagatgctgaccgatgctatgtacgagcgcatgagccaagtggcccaagcacgtgctaatggcgagacttcgattgctctggccatgttcggccctcagtcggtgagcgtcgaggatgccaatgccaagtacgagcggtttgtggactccttcaccaagctggtgaacacccaagctggtgtgggtaaagacggttcgctgttcttcaagagcaacccttccaaggatccgaagaagtccttcgaccctgtgaagttcaccctgactgcccacgatatcggcaacatccagtccaacgtccgttatctgttcgttgacccgatgcgtgacgctattcgtgacaccgtgggtggcgagctgctggatactgccgagatgctgcgtatggcaactcaggcccagtccattgttctggagcatgccttcaaggctgaagttgacgccctgctggcacagaaggccgaagacccaagctggaagaagaccgacttcctgacccgtcgtgagctggatggcatccgcaagaagctggagcatctgagcccactggttcagaccgagcaccagaacttcttcatcgccggtagcgagactgctgacgttgaggcgtcccagttcggtcgctctctggacggtcgcttccgttccccggctttcgtggctggcccaactgacgctggcgtgtcgggcatcccgttcctgaacatcggttccggtgatggccagatgatgcaaaacatcagcgtggctcctaatgcaccgaccggcaccctcaagatcttcgacggtatgaacatgccgttggatcagatcgagtccggttccgaggtggcaaacaaggccgtgatggactcgtggatgggcaaccctctggctgccgttcacaagtcgttcagccagttcgtgtctgacgccaagctgactgacctgagcaaggaagcccgtgaggctctgtccgaagctctgtttggtctgggtgacaagtcccacaccgagaacgagatcgtggacgctatgacctcgctggtgagcaaccttgacactgctcagcagttcatcgaagcccgtcaccgggtgatgagccgtgtttctgtgtcggtagaccagatggctgctgtgggcatgccgtacacccaaaacggcgacctgccattggctggtactgatcctgactctatcgctgagcaactgaacgtctacctgatggcagagctggcttcgatgcagggtgacaagccgtcgcacaccatgtcggctgacatcgctggcgtggcacaagcacacgagactggcgtgtcgatcatgaccggtgctgacctgccccagctgaagaccatcttcactgctgagcagaaagccgtgctggatgtggttgtcgattcgctggcagctcaggactacaccattgtcttcggcaatgctcagcagatcgctgactaccaagcagaccgtggcctgccgggtgcaactgcatcgcctactggtgaagtcttcggctacaccaaccccggcgacaagacgatctacctgatcagtccaaccactgaaaccttcatgcacgagctggtacacgctgccaccttcgaggccgtgaatgctcactatgctggtgtcaccaccaagccagtggcagatgcagttggtcgtctggaaaccatgatggaagacttcctcgcctcgggtgctgagctgactcagacctcccagtcggtgaactctgccttcaacaacgtctcggctgctatccaagaccacctgtcggctggccgtcctgccgaggctctgaacgagttcatggcgtggaccctgaccaatgaatccttggttcgcgtagctcagcgtcagcaggtttccaagctggctcgtatcaagaacaaggtggtttcggccatcaagtcgctgctgggcatcaaggaatcggctggtcgtgacctgttcagcaacttgctgttcaacagttccatcatcgcccactcccagcctcagctggctgagcggtttgctgctggttccctgttcatgaacagcaactacggtgctgaccagcgtctggcagatgtgaacgacaccttcaacaaggcaatcggtcgctacctgcaagaagccccaactgcccggaacatcgaccagcagtcggccttcatgaccggcatccagaatgcctaccgtgtggctgagtcgttcatgaataacggcttcaacatgactgcccaagaggccaccacgttcaacaccatcgtcactgcactgagcactgaggccacgcttgatccgaatagcatggctgccgttcagcagctgtactcgcatgtgatgaagcaactgtcgcctgagtcgttcatggctgacccgaacagcactcagccgggcgtctatgagactgcggccaagaagttcgatgtgctgtccggcaaattccttgtcacccgtgacctcgctggccgttccagcctgctgccagctttcttggcactggccactaccaacaacgagttccgctcggtgctggagaaactggaactgccgaagactgctgccaacaaggcgggcactctggacgctctgctggagaacatgggcaacagcatgatggaccgactgggccagcgtatgactggaaccaacaaggccaagaatgttcaggaggccattgacctgctgaacgctcacatggccaaggtcatcaacgaccgtgagacgctgatcgaccagtccttctccaaggctggtggcgtcatcgaccgtgcaaatgatctggtaaccagtggtatggagcgtctgactgggcaagctatgaagttcgccaagcgtactcaacgcaatgcagctggccgtctggaacgtactgccggtggcatcgtggctggctttgctgccctgatcaacgagcaaactgccaagggcgtttctcagtccactatggctgccatcaacaagaccaagctgtgggattcggttcacaccctgatcaacgatgtggtcggtcgcaccgacagcaatgcttcggtttacgacatgatcaaagcagttcgctccgtggttcagcgtactcgccagcaataccgggagaacctgcctgagctgctggcttcgaagttcagccgtgagctgaccaaagaagaaaaggccagcctgcaccgttcgatggcgaagactgaccttgctgctctgggcaaagacgcactgcaactggctgtcaacccggaagctgctatcccagctctggaacagggtctgtctgccaagcacattgagaaggccaagcaactggccaactacatgctgactggtgtaccgggcaagaacctgctccgtaacccggaagctgtggcccgtctgctgggcgaaggtcagaaagtctcggctctgcctgacgtaggcaagttggaccggctgatcactctgtacgccctgcgtggtctggaccaagcggacaaggatatccttgcttccttggctcaagacgaagccactggcatgcagttctcgctggactacctgactggccaacgtgctgaggaaaaacggaaggccactggccgtgccaagttcaactacttcaagggctacgtgcctgagatccgtaacgaaggcgtgtccatgctggttgcccacgacagtgagcacgccaagttgctggccaagtcgtacacccgtgtgggtgactacaacggttcgcctctggaacgtggactgaagcgcagctacttcttcatcccggtttctgcccgtgccactttcgagcaaggcatcatgcagaacgttcagcagaccgctggcggtgtggatgcctctaccggcttcaccctggcccagactgctggccgtatcaccgatgctgctgacgtgaagcaactggctcgccgcatgcctcgtgatggtggccgtgaggctctgctgccggtctacaacgaagctggtgacgtggttgccttcgagcgtgctttggacagtgacgtgatgtcccgactgctggctgaccaagaccttcacaagtccatcggccaatggcgtggtcgccaagttgaggaaggctacagccaagtcttcaacgaggctctgatcggtcgcctcaaggacatgtacgaccgggatctggctgaaaacccagacaatgcccgtcagtacgtggacctgctgagcaccactgatccagtgtggaaggatgctgtcagcttgatgaaccatgagactcgtgctctggtcgagggcgccttcggtgacaagttcatggtacgccgtgacatgatcaccgatgctgtcggctatcgtgctgcctcggttggcgatgtttggactggtaacacccgctggagcgagggcacccgtaaggctgttcgtaacgtcgccactgctgtattcggcaacgacgcctacaaagccctgctgactgccgagaaaaccattcagtcggttgtggcagatgccaagaccttgatcgtggtcaagtcggtcatcgttccgatgagcaacctgatgtccaacgtctaccagctgattgcccgtggtgtgccaatccgtaacacgctgaaggcattcccggctaaggctgctgaagttgaggcctacaccaagtctctggtccgtcgcatcgaagcagaagccgagttgcgtgcggctggtggtgatcctcgtgttgagcgtcggctgaaaaccgagatccaagcgatcaacgacagccaccgtcgcatgagcatctggcctctgatcgaagccggtgagttcagcggtattgctgatgccgggatcacccgtggtgagatcccactgacctcgggtcgcctgcaagcctacatggaacaggccgcatcgaagctgccgggctggggctcgaccattggccgttacgctctggtcaccaaggatactgctctgttccaaggcctccagaaggcagtggaatacggcgacttcttggccaaggctgcctactacgacgacctgacccaacggaaaggcctgactcagaaggaagctctggctctggtgactgaagagttcgtgaactacgaccgactggctggccgcttccgtggcaccatggaaaacctcggtctgctgtggttctacaacttcaagatccggtcggtgaaagtagctgcgtcgatgatccgcaacaacccagtgcatgcactgctggcaggcatggccccggcaccggagttcttcggtactgtcggtctgccgattgaggacaacatgatcaccaagatgtttgacggcactctcgactactcgatgggaccgggccaaggtctgcggtcgatgatgttgaacccttggatcaatctgacgcagtaaaaggtgttgacggacgccaaggttatctctaatcttggctccgttgttgggggttcgccaagttggttaaggcacgggattttgattcctgcacgcgaaggttcgaatccttcaccccctgccactttttggtgagtagcaaagtggtaatgcaccggactgttaatccggggatcataggttcgaatcctatctcaccagccacggtgtcttagctcagatggttagagcgctcccttgtcacgggagaggtcacgggttcgaaacccgtagataccgccactttttcgggtgtgtatgcaagcggtcgaagcaaaccggctgtaacccggcacattgatacaccttaggttcgaatcctaacgcacccaccaaataaaaaagcccccttcttcaagggggctttttcttgtccgacgggtagtcgatcagccagagaaagccaagaaccaagcaggccactatcgcaattgcgattggtagggcggcagcgtggatggcactggcaacacaagccaccagcaccaacaggccgagccctactaagagggctcggaacatggcttagttctgctggttgttcggcttgcggaggttggcgaacagcgactgggtacgcggacgctcttcagcggcaggctcatccttgaccacttccggctccggctcttcagccggttgctcttctacagccacgggagattcagtgggttggggatccaccggagtttcaggctcttcagcctgttcaactacgccaccagcagccgaactcgatgcagcttccgaaggttgagcatcgggagcagagttggtctgggtggaggcctgctgttggtttcccacagcagcgtcctcgaccaccggtttggtttcaaccggagccgattcggctttctggcgacgctggcgaggcttacgttgcggcttgccagccgggtccggagcatcaacaatgcccacgccttcgttcacgaagacagcaatggtgccgtcctcttggaactcgacgtggaagttgttggagtcgtccagacccagctgggcttgaacatagcccagtaccacgtcggagacttcagattggttcagggtgatttgcattacgaagttaccttcttccacagggtcatgagttgctggaactcgggggtgagtactccagcatggattgcaccgatggcatcagcccggtgctcgcagttgttcgtgggcttgcctcgatgccacgtccacccggcatccgggtagaggtccatcgcagcagcgatcatgtcagccttgctggcattcgggttaccggccagggcctttttaacagccttggcttgcacctcgatgacgatgatccccttggctcgcatggcaccgacgataccgtgggcaacacccacagacttcatcgcattggccgactgggaaccaacaggacactcggagaacacgaccttcacacgctccccaacaaggaaagcgtgtgaggccagctcttcagtccggcgtagatcgtccgagttggttcggacttgtttgtccttccccttctcggtcgattgcagctcagtcttcacgtcggtgagtattccggtgttcaggcaaagctggccttcagcggtcccccagttcgtgaaactggggtccattccggcaaccgggatgatcacttacttactgaacagcgacttgcggccaccagccggggcagcaccaccagtaggcggtttgccagcaggctttccggcacccggagcagcacctttacgcttgtcgtaaggcttgtccttgttacgttccagccagctgtcccagaaggacgattcctgaccggcacgagcctcggccatggtgaccttcgactcagtgtggaagaccttggcgatctggttcagctcgcgggtttcgccagtcggctcgtactcgccggtctggtcgttcttcttggtcttgtcttccagcacgtgctggatgcccagcgacacttccttgtcgcagagatcgacggcgaccatgaccttggtcgggacttccttcttctggtcgtagtcgtagatcttcagggtcttctcttcgaagacctgttcggccagcgggaagccggtggcagcgaggcagatgtcgtcgatggtggtgaagcccggcagcggaaccttcttggactggtcgtccttgttcaggaagaagttttcacccttcttgttggtgatgtagatggtttcacggtactccttgccatccggcaggatcgccacgacggtgcagtttttcgcaccggattcagcctgaccggcgtacagcaccttgaccttgacgttgtagatgtcagtggccaggggcttgaagccaccgcccagacgatcttcggattcttcgaggccggtggtagtcaggttgccaaacagattgctcatgattttttctctcttgattcagttcagggtttgggcacaccacaacggggactagtcgttgtagaacttgtgcaggtggtccagcaagagctggcagtcgttgtccatgaaggtttgcgaacgactgaacatccccatcggtgaacggatacgctccccggtggtggtcttggtgggccgggtttggaacacgtgcttgtaaccaagctcttcgtcttcctcggtgatggtcaatagatcgctctggtatgcttccagagttttcagatccaccttttttgctgccaccacggtggagaagtaggcttccacaccattgcctttcagggcacctttgatcgggaccgaggtcttgatctccattgccttttcgttcagctcgtccttcacgtgggccgtgaagataacgggcttaccgaagctcgccaccttgctttgcatggtggtcttgaagaactgctggtagttagaccagcctttcatggtgtcgtgagcaccgagcacgtacagcgattcgaacatgtccatcaggaacgtcagcgagtcgccgatgatgcccttgatgtcacgttctggcaggatcgggttgccttcttcgtccagcagagtgccggtcgcatagtcgaacgcatcatgcacctgatacggatcggtgatgatgtgacggtcgaacttgttcttgaagggcagacgcttgcctgcttccgtgccgaggtacagccaatcctcttggtcacggatgttgcggagactggccgacttgccggtggcggattcgcccacgacaaggatcagctgatcgttcatttgctcttcggacatgtgtcctcctgagtgcctgacagccatgaaagactgtcaggcggttgcgggttacttccgagagaagcgtttgccgacagtcaccatgatggtgctgtcgatttcttcctcgtccatcgggttgttcagcttctggttgaaagcgtgaacctgacggcccacttccagaagggacatgccgttgtccaccagagccaaggcgaacttgatcatctggttgttgcgattgccgttggcgatacgacctgcaaaccagcgttccagattgtcgagagattcgactttctggtactgctgctggtacttgtcgttcatggaagtgcgtgggatgaactgaagcacgtccagcaggacaggctctggcttcccttcttcggtggcaaactcgttccggtagaacgtcccgccactgtaggtttcccacttcttctcggcttggttggccgattcgtccgtagcgaacggcagccagttcatcaccgagttcatgaactccttgtagtcgtcatggtcgaggtacaacttgaagttcatcggcaggatcagacggaaacggtcttcacctacgatgtcctcgccctcgctgtccacaccttccacctgacgatgacgtttggtggtgtaggtcatgaacttgtactcagccatcagctcatgcacagcagccagactgacaccaccatccacgtcgatgatgatggtgttgaacccttggatcacgttttcacgtgcccggtggccggacttgaagtggtggttggcccagtgcatgggcgagccgtcttcttgctctgcttgggtcagcaattccagctggctgaagggcacctcttcgttgctgtagccgtaggcccagtgcgtgccataggacacgatcagctcgtcgaggttggtttcctgcaacttctcaccacggaagaactcgatgccatcgacgaatttcttcttgatgatgatgttccggctgtagccagcggccacggccatcgtcatcagctcattccgtgctgtgttgctctgcttgtagaacggcagggcctcgtgcaggtcagcgtgagtcaggtcagtgcctacgtcggcgatgtaacgagccaacttcacataggccttctcacgggtcaggatgcgtttgaacgctgcacccgactcttccaccagcagaatggactgcttcagatggtccatctcgatgttcaaggaaccgtcgatgaaggccaacgcaccagcgagctttagagccttgaagtagcgatgctccatctcggccttacgcatttcctcgtggtcggccatgttctcggcagccttcttgcactcgatctggtaggtcaacagggcaatgcccacgtcgtcctccaccttcattttccagccgaatacggcaggatcagccaagctgtggaaaatgtccgaccacttatccaccgtggcggagttcgtggggttgatcaacccggcgtaaatctcagccggggtcaggtgcaggtgagccttcttctcggcctcaccccatgcgaacaggcaacgacgtgcgtagccagtgtccagcaaggagtagaagtcgtcttcggtcggcccaccatcgaacagcttggacggagtaccgaacagcagcaagttcgccggggttttcccgtcaatctcttcgcctcgttggttctctgccgtgttcttggtgagcttaggcttcaccagaccttggtcaaacaactccagatacagagccaatggctccaaactggcatgaaggttggtgccgatctcgtccacctgcaagttcaaggaaccgcagttggacatgaccagcttgttacgcagctgcttgatcgccgggccggtggccgagtcgaaggtgaacggcaaaccgcctgcacgcttccactcggcttcggctttctcgaactcttcctgctggtcagtaccgttgcggactgcccggtcattggcgatatcccacaggtgcttctcggagacaactgggaaggtgtcttccatgaaacgcttgcggaaaccggcaaggaactggttttccacgatgttgacggagtgacccttgccgtagccagaggtggccagagcaagtgcataaaggttgaccgggatctcgccacggtctttggtgacgatagtcgctcgcatgcacgaagcgatcttggcgaggaagtacgccacttccactcggaagaagatgcggtcggtgttctgtgttttcgagcacaggacatcgacgatctcttcaattgcggggtggtgcgtcaccccggtcaggtcgatcatgtgttacctcggtgatcagatggattggtatttcgggaaggtgtccttctggctgcatgcgtcgaaagcatcgcagtagtcgcagcgctttggctcgcccttcacggtgatgatggtgcccttgttacctttgctggccatgtactggcgggcttcatccatggagtcgcagttcttcgtcgcccggccacctttcatggcggtttcggggttcgaatagtacttgtagaccggatccgtcatccacagctcttcgtcagtgcagtgagggatctccttttcagggacacgcatatagcgttcgatctgctccagcttgttcaccacccacttttcagtgtcggtgatgtccaacagagggatatccttgaactccagacgctgctgggggtacttcggattggtacgggcttggaacttctgccagtcggtgaagatgtagttgatacggatgaagtcctcgtggatcttctccgggttgagccagcgatacagggaaccctgcaactggtgctcatcatcccggccaccgtacaaccacgtgtaggccgtggtggtcttggtgtcctgcacgatgccatcagtcaccatgtcgaacttgccaccaacagtccattcaccacgggttgtcttcactttcttgaaggcccgctgctccacgtaaaccaatatcgggtcgccgagcttttgctctttgaagctccgaatggtcgcctcgtccgggttgaccagtacacgtgcaatcacgtgatccggggtgcccagcttggcgaggttacgcttgtagttctggacccaagccttttccacggaatcgtggatggagtggcccaacgcacgctgcaccatgtcagcaacgtcgggggcttgccgttctgcttccgggatacgccggggcagaacgatttgacgcaacggcttcatcaggctggtggccgagatgtaattcggcttggactggtagtcgtagtcgtcattgacggcccagacagccagagccagcgagatgccagtcttgttcgtgatcatcaggtttccccttggttcaggctacagggcggtacagggcgatagccgatgcctcgctggagaacggccagtaccagctgtccacatcttgggcaggattgatggtgccgtctttcaacatgacttcgaccatggcacctttcggcaaccaagctggacgtttgccagtgttgtccatccagccgtcttcatcggctggtgggatcgaatgaacgaacacaccggcccatgcacggggctcaccggcacgcttacggtacaggccccagtccaccatatcggcattttgtggtcccatcaggtcgccattgacacgacgcatggtcacgatggacttgggatgcaagccttcgggcatggtgccgatgtcggcgttgtaggcgtaccacgtgtcatattcacactcgctgccttccattaccggcaaaggctggtgttcagcaggctcaaccggcacttgctcttcgctggtgccggacatcagggcgatgtaacggttgagggtgtcccgtgcctcgatcacgtccttgagcatggtcttacccccggagcgtactccggggatcagcagcttcttccgagcgtggatgatggtcccggtgggatcatccaccgggaacatggcgttgatgacgtaggtatcaacctcgtcaggtttgacgccgggaggcagggccttgtagtacttggggtacttcttggccaaggattccatttagctcaccttggcaggcgagtggtcttcctcgacggcaggttcgccatcggagacgatagacgggccgaagaactcttcgtcggtttgcaggccgaggcccgacacggcgatgatggtcacttgaaccggctggatttgcaggccttggttcgccgcaccatcggatgcgacttgcatcaggccacgggtggcgttggacaggtcagcaccagacactgccggggcaatggtcttgatggtgcattgcagggtcgaggcctgaacctcttcaggcttgccgaccgggtggaacacgacttcaccggatacgagccagaagaagtatgcaggggcttgcggtttcgcttgagacataacgctctccaatgaaaagaggggtgaggggatccccaccccatggaacaactacggggtaacttcagtgaccccacccacgcattcgaagacgagcttcggcacacgggcgttttcgccagatggcgaggtcaacagcacgtccacttccagcaggccaactggccagctgtcagtgttgctggaagacaccgtgatctttcgagcaaggttcttgtccacccacttgcactccagctcatgcacgagcccgtcaggctgccgattggcatgcacacggacctgtgacagtgggagccagtccgccaacgaaccgtcaacgtactgtggggggatgtcgaaggtgtgggagaacgagcccccacgggtgaagcgagtagggcggctcatgctgcctccaattcgtcgatatgggcctgaagtttctcacggatcacctcttcggttgcaccgttggggatcaccatttcttcagcccacgaaggatagaacagagacagttcgccacctaggcctacttccgggtggtagatatccgggtggtcgttccagttcacggcatcgaccaagtgcttgttcatgaacagcacgcaggccatgtcgtcgcgtaccaatgcatacccggcgtcgtggatctgtgcacaaggccggatggccttccgcataaccgggtccggtcgaacatggacacccatgaactcagaccaagcccggctgttgagcaaacaccagccctgacccagtgcgttaccagcagttcggccttcggcttctgcctcatgcggagtcctactgtttccacgtaccacttggtgaagcagtggggtacggacacgcagcccgaaggccgttgtcacgtagccacagcgggacgcttcgtccagcttatcggccacccacttgtcactcacgacgtacagctcgtggtaacgcttttcaaccgacttggccttggcctcatcgaaaccgcagttcgtcatcaaggtgatgtacgttccttggtacgtcagggcgaaggtcgggttcttcgattctgcccggagcggcttgtacttcttggcgatactattgatggactcaacggagttcgggtcgataccctccatctgatcgccaaagtaggcataagcacgcaggcagtgaccgtcgaagccatcggtgtagaccttgagcttgttcgggtctttcgtcgtgagagccgagatccggtcttccagcgacgagaagtccaaccccatgaacaaccatccggggggagcttggaagcaagacttgatgtacttgccgtaacgacccttggccgtggcctcgccctctgcccctgctggcaggttctgaaggtttggtttggagctgctcaggcggcccgagacggtgccaccgaggttgaagttgccgaacaggtagtgccaaccatcgagtcccggcacagcccctttcagagccttgatgaacgtgccgatgatcttgtccacgtccttgaagtccttgagggccttcaggagttttttgacctgctggttcttggtgtggttgaccaatgcatccagcgagtcgccatcggctgacggttgcttggtcttggttcgactgagtactggcagggccagttggccgaacagcagctctaccatgtcgtccggcgagttcgggttgaactcttcggcagcatccgccatggtgacccgcttgaccttcagctcgctgttgcgtttggccacccaacgctcgttcttcgcatggacgaactgctgaaccaacggggaactctgaatccggtgcatggcgtctgcccgctccttctccaaaatcccttccactttcagcacacgcttcatgttgaccggcatgccagtcaactgcatctgcacaatgtcgatggtcgcaggcttgaataccgaggtgtacgggtcaacctgctggtcatgcaccatctgtgggtggcgtttctcgtagacgtaccacgtggacagggcatcgacgaggttgtattggagcagcttcggcagctcgatacgtcgaatatccttgatgtcctcgcccatcgagtagttgccagcgaactcgtgtgcttggtctttcagacccagcttgttaccggcacagctgttggtcgccagataggtgatcaacttggagcagtcccagttacgcagcaggacttccagaccttccagaaggccgtcctgatcgaggatgtccgtcatgaacagctggtagatcagcacgtacacgtcgaaggcgatgttgtggtagatcgctttctgcataaacagcctgaagaactgtttcagcattgcacggacaggctcgttgtagccctgtttgccgtacatttggacctctgtcttcccgacaatggtcttccactcttcgctgatgtagtccacggggaatgcaatcccctcgtgtttgctccatgcgaacgagatggtcccgatcccgcatttgtggtgcttgaggtcgaagccttcaatgtcgatggtcagcgggcagtccatctccagcagccgaatcagccactgttcaatgtcctctggccgagttgggtactcagcaaagtggatgatgccggagccgggggcctgatacgtcccccgagcagcagcacacaaggcgttcatggccatgtcgatcttggctttcaccttgaccgggtcgtagaacattgccttgtagttgggcacgtagatgaccttgaagtcacccatggtgcagtccatcacatagccgaggttttcttccaccttcgcagccttggtcatggccttgaagtactcggcgtcagtaatggccacgtacttgaccttgccagctttgaggtaagggatcacctcgctggtgaggtactcacgcatttctgccatcggcgtctttttcttgccaggggcatagtgcaggtcgagagccatgacggtcttggggtcaagcccgtatgggtcgatgtagtgacgcacgaagtcggctttcttgatctgtggaaccaagaagcaaacgtcgtaatgctctgcgtcttcgaacgtgaggtagttcatgtgcagccctcagtagatcatgccgcacgcccagtacacgtcgatcttgtcacgcatcaacaggtactgactgtacagccgttcgttacctttcagggtgtagccatcctcgtttgaccggggatgttccttgaggctcgtcagattaacgatggtttccggcaatgcattacgcacgtccagtaccgtctcgcaatccttggtcgccagccacagaacctgcatgatgagctgcttatcgtcttcgacgatcttgtgctcagccacaaattgggcagcctgtttggatagagtgaaggccagcgacgggaccgacttggggcgttgtttccctttcgggacgtacacctccccagcgtgcatgaagcccggaacggtgtacttcttgatctcacggttggcctgatcgagttcgatgaccaaatcgttgagtcgtctttcctctggttcaaacagcttatccacagtttgttccagaaagctgtgcaggttctggatggccattagcgaacgaggcctccgaacttgggtgccaagtcgccatagaaggcgacacgcacacgggcacgggacactgccacatacagctggcgggccacctgagacacgttgcggcaggtgctgaggttctcagcgtcgatgtacacgaccgggtggctggagccttgggccttgtacacggtacgggcatcacgttggcgaaggtctgggaacttgcctttcaggtcgaagtacgacttccattccttcaccttgctgaagtacttgatcagctcggcgtaatgctcacggttgaccggcaacgggatgctgaactgatcgccgtaggcgttttccaccagtgcctgacgcacttccagctctgcaccacgggccagctccaccttgtcggtatagctttccacggacaggattttcacctcgtcttcaacggagaagccgtacttgccgaagcgaggggcgttgttggagatgagggtttctcccggctggaactcgtatggcaggccacgtagatcacggatgtaaccgttgtaatccacaacacggttgttggtgtaggccagaatcacgttctcgtggttcgggtcagccagatgggtgtcgatctcgtcttggaactcttcacccgtcagccagtcgatgatgcccggaatgatctggatcggggtgaagtcgtggatatacacctgctcgtttttgtcgttccagtcgaggcgaccggactgcaccacctcacgcatctgctggttgagagcttgcagctcagggatggtggtccgcattggctccagcagctcgaacatgttcatcttgtgacggtacaccgggctcaattgctctttcacaggagccaactggtccttgtcaccgacatagacgatcttgcaaccgtcagtgcctgcctgaatttcttcgtacagggcactgtcgatcatggacgattcatcaatgaagatgatcttgcccatgtgcttgtaccagttcttggtacgggtgatggtggtcgagccatcggtgtagttctcggtcaccttcaagttaaagaaggtgtgaaccgtttcagcaggacgaccggtctgcttgcccagcacctcggcagccttgttggtggttgccgtcatggccacgctgtggaacaggggctcgatgcctaccaacttgcaggcgtcgaagtacatcgggaggatctcgtcgatgaggtggcccatcaggaaggtcttgccgaccccaccgggaccactgatacggacctccttatccggccccatgaggaattcgaagaagccgtccgaggccagcttctgtccttcattgaggggcagctttttcacgtcttgcaacatggggtggatctcctactacgaaaaagcccggctcaatggccgggctccttgggtggttaactcagaccggcacgaagcggacgagtacggccttgctgtagagcgggcctttgatgactttaccgttggagtcgtgcaacgggttgccttcagcgtcgaacttgctgaagttggagcggttgacttcggtcatcgcccccacgaaatcataaccacgggtgtaggcgaccccggtgccagtgaccacttggtcagccagtgcgtcgaggaagagcacttcgctcttgacgacgatcaggacttcggtggacttggccttcaggtgctcagccagttcgtggatagcacgataggcttcactgatcaggcggtcggtcaccagatcggtgccttccagttgttccagtgactcggccacttcctcgtagtggcagcccagctgggagttctggtctttcaaggacggctgtggacgagccagttggaaccacagatgagtacgcgacaatgcacagttgttgttcatgggtttccttggttcaggtaggcctgtttgatcaggcggtatacgaaggtcttaacggaaatgccctgtcgggcgagttcatctgctagccattcctgttgagtcgcatcgagacgcagaaacacgtcctccatgaaggtacgacgggtatcggcaggctccacccccaagcgtttgagacgcaaggtgacggtagtcgggtggcagccgatgcacttggctacggtggccagagaaaggccaacgctgtttaggcgaagtacatcagcatcagaggctttacggttgacacgaagaacggacgacatagggggatgatctccataaaaagatacctctagtctattacgactagaggcatcttgatacagcgattacagcttggcccgctcggtgatcttcttgatgaacttggcgtcagtcacgccgaggacatcccaacccttcttcgctttctgcttgaaggcgacgatctccttcgcgttctgcttgtccgggttgcggttatacaggtccacaaggtgggccatttgctcttgctgggtcatcttggtcttcttcccttcgggcagaggcgaccccttcggagcgaaggtgtcacgagtggtggttggttttgccttcacaggcttgtcgatctgctgcttggtcggggccttggccttgccagtggctttcggccaagtcatctgcttcaacagcttgtcgtcgttggacggcacagttttcggcagagactcggcagctttggccatgttgaccatttgcgttgcctcgtcgaagacagcaattggtacgcccagagcggcccacgacttcttggactgcttcttgaacgccagcaaggccttggccgcttcgaccttggcatcaatgatgctggcctcttcgaaggctttgaccagtttctgtgctggagtcagctgcttctcagcagctttggccggggcaggaaccggagcagctttgcctactggctcaccagcgacttgcatctgggcaggcggagcgtggaacttttgctcttcctgtgcaggtgtagcctgcgacagggccaatgcacgggcatcaaccttggcagctgagcagttttcagtgtccaaatgatccagcgagttggacttcaggctggagtccaatggtgctggctctgcggtcacttcaccagcaggggtgattttcaggccaccgcccttggcaccggtgatctccacgtactccaaaattggagtgtggttaccagcgacggcattgcccagaaggatctggtcttccatcggctgatcacgttttacgcgatcacgatcaccgtccgacaaacgggcgatgatgtggtagcccttggcccggagcttacgagcgtcgtactgaggtacggcgatcacgtcctccggggccagcttggccaacacgcacacgtcaccactgaagctacgcaggtagtcccggcgagccacgtgcaaaccgttggagcagtcctgtctgcggttcgggtccaccatgtgctcggccatgtggacaaacgagcctacacgctgcttcacgttgccggagtggcagtccacgaagacaccttcttcactggtggacttcagcaacttgtagaccagcacactgccgtcgtcagccagcggcagttcacccttctggatgaacttgagcaggtcttcgacggagtggccgcgtttgatggaaccggcacgacgcaggaagttggccatggcatcaccggagctgacgcccgacgatacagccatagtctgctgagccaaggcctcacagccggggatgatggtgttgtcgtccagcacggcgatgacggtggtttcttcctcgccttgggcatcttcgttggagaagccgggggtactggccggaacagcattggccatgatctcagccacagcggctgcgttcttggtcagtggacgctgttcttctggagtcagctcgacaacagcgtcttgctccagctcttcggcctcgggagctggggccgtagctggttgttccgctggttcctcggccttgtccgtagtgcccatgacgacaggcatgatgggttctgcgaatttctccagcagctccttcgccttggtcctgaccatcttgaagaaacgggcgacaccgcccatcttcttctcggtttcggcgaaggtgttcttgtcggccatgtcgtcctcggtcagcatgtagaactgcggaccttggggttcaaaagccggaaccatcttcgccacgagatccttcaggcgaagatcgccttggggaatgacgatggtttcaccgtcatccttgtacagggtgacgttgtgaacatcgacgacgcagcacacgatcttgatcgggtagttcattgttgcacttccttcagaagttgacgggtaagttcatacgggatggcgagtttctcgtcacccggagcacgtgcttgcagtgcttcgccgatacgttccagattcacgtaatgagcccatggggagtcacgcagggtacgcttcaactcggtaacttgagggtgcttctgcaccttttcagctagcaggttgcatttctccatcttcttcctgaagccgtgaaagctgctgtcttcgaagaactgcacgagagtcatcgtctcgacagagatggtgaagcggaacttgaacggcaaggaatctaccagttcttggtgcaggcacatgttacgcaggatgccatccacatcactggcatgatgatgtgctgctgccgggaagtaacgggtgaacgccaaatagcggcggaaatcaggtgcagccgacaaagtgtcgtccacatgctgagcgacgtatttactcacttcgggaatccccttttcgatgaatttatctacctgtaccgtggtgatcacagcaatttgcttgccccacaacttattgaccaattgagacatcttagggctcaggtcgctgaagcggtcgcaattctgttgggcgttgttgaggaccacataggccacagggtcgaatacgtgttggtctgggttgtccggttggacgttcaagcgagctacactcaagaggaagttgccgtcgccgttttctgctgcgtgcagcggcaggtagcctttacgcttgacggtcggcttcttcggagcacgctcttttggctcttcgccgggagcacgctcgtaagtggcacgggccgggatgtacgtgtgaacgtcatagcccagcttttcgaacacggccttgatggcgtcatagtgcttctcatgggagggcaactgatagacgacccagccggtacggcgcttgtcccctttgttgtggagctgctgctccatgaactgcttgatggcagtttgggagcgagccaacaggacacgcttgaatgcataaccgaacagcttgtgtggtgtatccgggttttgacgccacgggttgatgaactggatgctggtgctatgttcgtagggctcgtagacatacgacaaacgctcgatgtccatgaactcttcggccttcacagcacgtaccagcgggccagtgacccacttgtccaaagcgtacttcatcagctctggtggccgacgacccggatagctcactttgcccttacgcatagcctcgtacagtcgagcagccttcaagaaagccttgcccatccgcttgtccatgcccggtagagtgtgaaccgcatggtggaaacgcttgattaccatgtccggcccgttgtaggtcagcgaacggcgagacagcatctcgtggagtgctgcccgacgaagttcgtaggcccagatgccagcctcgtgttcagcgatagcacccttgatcacgggcaggttgatgtctgtcacgaggtcagtggtacgggtcaccggtggagcttcacggatgatcttgttgaccagcgtggcgtttacctgacggttcacgtgcttgctgatctctgcttggcgagggttgaacttcgccaacagttgcttgatcgtctcgacggtggtgtcggtgaagatcagagcttcccggctaggggcgatggagatggtgtcaggctcagcgaggaaaatgatgttggctgcattccacagctgttgcatgttcttcgtgacctgatcccacatttcaccgtagtgatccatccggggaaccgggtagaccacgtttccataacgcaggttgatcttctgggtcagagtgcctttgaagctgttgatgatgtagccggtgtgggtgccgtcagtaggcagcaccagcacacgctcaccattcaggtcagcatggatctggccgaggatcagtacctcgcggatcaggcgaacaaagtcagcagcatcatgcggcgacttcagggggatggtcacacggatgccagtctcttcggttggcacctgcacgatggtgtcgatggagggcttgcctcccttttccatgctcgacttgctcacacggtagaccgacttgacacccccgtggtgactgatcacttcgaagttgtcggtgtagctgaatggggccttggatccaagtccaaagcctccggtgaccgaaccgtcgtcacgcttggtcgagttaccgaacacaccataaatcgggccgatcttttcgtgagggatgcccggaccgtagtcacggatcacgatattctgctcatcgacggtgatggtcagagccttgtcggtgcatttgccgacgatgtggccgtcccagccgttgcagatgatctcccgcacggtggcgagacgagggtaggtgtagagagtggtggagaagatgtgcatcagagccgcactgtcgctcacacccatctcaacagattcttttttgccgagaacggcatgagttacagcatcagacatctggctgacttgcatttcgatactccttgaggaatgaagcggcccctgttacagggccacgaaccaagaaagcactagaacggagcttcttcgtccatcaggtcggcgaagggttctggaggtgcaggcttggggatggatggaaagaagcccatgtcgaaggtcttctctgggtagtcacgcaacagacgtgggtcggtgtttttgccggggtactcggcagcacgtgtctcttcgtcaaatgccttggagtccaccttctttttcggaacatgacgggatcgccgacagccataggtcatgccttcgtccatcatcttttcaacgaggtagtcagcgatctcgcccatggtacttactccgagatgtattcgccttggaccatcttgcggaattgacgccaaccggtcaggtttccgtgttcttccgggtttgcccagccttggtagaagtcacggtcatgcggatcgtacagatccggcgtggcctgatgctccagtgggctggcatggatcggctgggcaccagcgagacgctggtacagctccagatccttttccacagtcggcttttcgccgtcgtgggtcaggtacgacacacgggcacagcgggcagcagacatggcgatcagcacgttgaggatctcgctgctcgacggcatgtcacgggtgatacggcctttcagtaggtgattggcagcagcttcccagtcggcttgcatgtccacgtagggcaggtgccagtcgttcaggccaacatgctgatactggataccctcacgggcttcagccatcagatcagcaagatgcttgatctccggctgggcatcagcatgacgacgcaggccgtcgaagttggtgaagctggtggtcgtcatgatgacgtgcatccactggaatggctccagaatgcgattggccacctgcttgtgtagccccagatcagccagcttgccagccagttcagaggcatcacgagcaccgtcacgccagtgcttgatagccagttcacgaggatcgtggcccaactccagtgatgcttgcatccccggttgattcataccccagtgcatcggcatggccgggtcgttacgcacttgctcgatcatcttggctaccggtatggcacgagacgacgaggcgttgcggctgaactcacggtgagtcatgaactcagcgtggatgaagcgagggtacttcagctgcatggtggtgatcgggtgcccggacggactcaccgaggcgaggatgacttttgcttcgaagcccatgacgggttctccttggttgatgaatgcctgaaaaagaaaaaccccctcatttagagggggttttccatggcccaggccgaagatgtgttaggcgacagcaccggcacctacgccgatcttgcccttggccacctcgctatcgttgacggcgacgttgaccagttcggataggcgataaccattgctctcagcggtcagggatccactgcacgttcgggcgaccgaatcgacgctggccatgtaagcctgctcggcatggaacttggcaccttcagcaccgtggtcggtgacgtaggcgagggcggtgatcagatcgggacgcaggtcttcggcgaagacagggccagcacacagggcgagcacgccgaggcacatgccaatcagtccgtggtacaggcgtttcatgatacgcatagcagagtttcctcttggttcaggttgggagaggtaaagttacctcgaatttacgcctttgggaagcgcatgatgtgaacttcggcacccagctcgccaccgagggcagcgatcagttcacgcagttctttgggcagctcgtcttcaccgggaatcgggtcacgagtcggagcggtggcagccggggccacgctgtctttcggcagcagatccatcagggtggccagcacggcatctttttccttggaggcattgatgccttccaaggtcttggcagcgttcgccagagtgacgatggcctgtgcgttggtcacattgacctgagcacgctggcggtccagctcgacctgatcgaacaggaagtggttgtgggcctgctcaaccatctgggcttggccgatggatggctcagctgcatgtggctcgttggcctgagcggcttgacgtgcttccagctcagcacgcagttcacagaagatgcacatatttcactttctccgttggaggggggttttttgtgcttcgtccagccatttctgaaggttctcttcagtcacggtctggcctatgcactcgttgatgaggtaggaagcgaatcgctcccaattctcaagttccttgattcgctcgcattgctggatgatggtctgtcgttgggcagcgttcatctgctccagcgtgcgagatacctcggccatcagctgttacccagcagaccacgcaaggtggaacgcagggcttccagttcagcattacctttgccagcttcgaggatggcggagtcaacctccatacccagttgctcgacttcttcagccacttcacgcagcttagtggccatggtgaagcagcgatccatcaaggatggcttcggtggttgggcctttttcacaggtgcagtcacaggggcctccacgggctttttagatttcgggggtttgacattggaacggaaggtgagcatccctgtctcggttaccagtccagcatcgatcaggcagcgaaggcagccagagatctcagctttggacaggctatgtttctcaacacgggccatctcgttggagatctggccaatcgaccagaactcctgcatgggtacagcagcgaacacctttcgggccagattggtctggccggacaggatgttttgggcacgttcgtattgcatcagccaagttcctcagtgatgagttccgacagtttccgagcgttctcttcggctgccggagtgatggcagtaatgtccccggaatgcagtagaagattcactgcccgcaggatggaacgcattttgtggatacgctccccacgctcaacactgattttctggtgatgagcagcgttgctactggcgacctcgacttgaagactcagcctgccctcgcttggccgcacgaacagctcgcttccctcgggagcgaggcttagatcgatcagggcgataccaatcctcatcggaccaatccccggaaagtcgtactgaatcgaggtcactttccctactgggctcagcagggacttcttctcgctggtgctcatgtgtctcttccttcaattgggcaaccaactggttgcacttttcaatgaacgccatgacagcgatgaccataggtgcatcgtccatagcgaggaacgccttgagcatcttctgatgcttgagcggaaccaatgggatctgtgcctttatgcagtcacgcagccgggccacatcgttgttgtggtaggccatgttgaactccaaggaaaacgcgacctcatcgggagtcttatccccacttggttccacaacccggaggttctgcatccatttggggatatcgaagacattggaaggttttttctttctcattactccgacctaaaaaaatgaggcccgaaggcctctaatggagggatgttggtgcatccgaggtgacacaacagcaaggacagtgattgaacacacgtctacaggtgctgagtcacctcggatgcaccatcacaaggatggtgcatccgtttgaggcgctcgccttgcggctagccccggcgcggccaggaagtgctgtttactcggcgctgtcgcccttggtcaggcgattgacgacggtctggtagctttccttgacggtcacttcttcaccggtgtccttgagggtgatgaccgattcgctgccagattcactgacgaaggcgatggcatcggcggcgatcagaacacgttggtcggtgtcgtaggacttcagtttgaggaacttggacatgcttttgtatctccatgaatgcaactgggaaggcagttgccacctataggaaaggtgcccgcttacatatacgggcgtgccccttaaagaactcctgtgtactgaggacttttccacagggcgtggggaagaggtgcccgcagagtggattcgaaccactgacctccggcgaccggcgagacgtaacgggagctaccctatctctgtggtggccagtgctctaaccgactgagctactttgggcattgaaagctacattggccgatcaacagtgagggcgtccccactgtgttgtgacagaacggaatcgaaccgcagctgttaatggtcttcgaggggaaatctctacttgttactcatgcgtaccctgacgccttacagagtgacccagcctgtctcctacagcctgttgatcgccaatgcagcttcctgtgactgcattgggctttgtccggtatgctccggtctttccggggtgattcaccccaagaaaggctagctttcctaacccgctagggcagaaaaactcggtggaagatcgggaccagagacggtcgcctcttcgaactgcccttgagcctttttgatgaaggcacggatctgacgagccgattccttcacttcaaagttcaagttgtcggctgcttggatcagcgagcctttgccctcaccattcagctgttcaacgctgatgatttggtcggaatttaggtctacccggttgccgttgctcagccgggtcactcggatgaaggtcatagttcagccctttcaatgcacggggctttcccccaagaaacagctcggtgttgcatgctgggcatgtcaacctaccgtctgcaaattcaacggtgtagtaccgtttgccgcacttgcaggcacggaaaccacggtacaccccattagtgaaaaccacgtcgccgttaccgttttcaacacagtcaccgcaaacgtgggagtacatcgggtcgatgagcatccatgcgttgggcttgttacacccttcgcatggagcccccggatcaggtgcaccagtcacttcgattcccgagccggaacgggacggtcctcttggtgttggtacttgccctcgtagtgggcaggctgacttgtccgatggaagatcacttgagcgatccccgaaccagccgggatcagcagttcttcttcaccgtgatagaccagctcaagggtcagaaaccctttccaacccggttcgatcacggtgttgaagacggacaggccacgacgagcccaagtggacttgtcgtggacgatccctgtcagatcgtccggcatctggaactcgtccatggccgaggccaaggcgaagcgaccgaccttattcgtcagccgtctggctaactcgttgtccttttctgtttgaaaagattcaacgtgcatgaggcccatctcaccttgacgccggaaacgcatagactgcttgatgcggatgtcatagccagcctcgctgagtccagccgaggtgccacccttcgcaacgaacttggtcgtggccatgtccttgatcggggcagcgtcgagtagtgcagtaccattgatgatcacgagctagttcctcatgtgaatcagtttcccgaactccaccttgcgaccagcagcacgcacggcacaccaaatcactgggatgtcgaaaggcagcttggccatggggttgcagtcaaggtctgagaagacgatggcagcagtcggtcggtgcttcagcatgtgctcacgcacacacaccagcgacgtaccaccagtgccgtaacggacggtttcctcgaagggatcctcatccaagaaaacgctctcatggacaatcgagcacgtgaactgcaccagcgtgagtttctcaggccggagcacttctttgatgaatttcacctcggagttgaaacgcagcacgtcgtggttagagcaactacctgacacgtcaaggtagtacacgatgtgccggagccgttcttcttccatcgtcaccgatggcagatagacccggtgggcgtaacggcgattggggcgagcccacgagtagccgttttccaccagatcagtacagaactgcatcagctccttttcccatgggacaaccggggcaaggaacttgtccagcgtctcctgaatcacttgagggatattgcccgaaccaccggccagcttgtgttggtgaatggcacggaggaccatctcaacgaccttctgtgcatcttccttacttggttcccttaggtcaccattgccccagtcaccttggcccaagctgggcattggtggtggtgggactaggacaccggagctgatcaggtcgtagatttcttcttcggccagtcggccattgtcgtcaatcgacggatccagacagcaccactcaatgtccttgaaactgaagccggacacgagcaggtcgttgttgatgcggtagtcacaggcctgattccagatctttggatcacgcccggcacgacggatgccgtgcagcagggccggatgccacagttcgtggaccaacacggttgcccgtgtttctggggtcagggacatgaagaagtccgggttccaccagaccttgcggccatcggtttcagcggtccgcaccgtttcgtcccacacgaagtccaacgagcagagcaccggacccaagaaggcagcagtgcccttgttcatgaaaaccttggacttggttttatccaactccttgtcgagtgtttgctcgtcgaagttcatgatcagtcagcctcgtaggtgtgttgggtacgaatgcccggcaggtgaatgcgtcggcccatctctttcaggatgtcctgacgttccatgatccgcttggtgatgcgttccttcatttccgtgatcacggcttctacctgatcaggattgccagcccacgccttgaagtagcacaaaccgtaggtgtccatgacctgctcgggaacaccgagcttgtcgaaggccacccgacggttgttctctgtcttgaacaaggacgtgcaacgttttgccttataatcctcgacgctgaccttgaagccgtggtcatagccgggagcattggacagcatcacacccacacagtgaagcgtgcaattgtggtccattggttcagtccttcaggtagttggccagctccagcatagccttgacgaacggtttctcctgacggagggacttgtcggtgatcatcaccgagcggaagaacaggatgcggaacgacaggtcgaagcggttcgcatagcgagacagcacgtccagcgtgtccttctccacgtgctccagcagggacgagatggtcgcccacttcgtagcgttatcccgagggatgaagtggttgtccgggtcgttcatgatgtcgtcgatcttcgggatcttgtcgaaaacctcgcagaacgtcacgaagtcggcagcgatcccagccgtgatggtgccagccagcaacggcgtcttcccttccagcgaacccatcggcccgatgatgcggtgagcgaactcccacgtccgtggacagcagaacgtcttgtcggtgtgatccggcttgaagtccatcaggcggcccggatactggttgaggtacgcgataacacgtttgtcgtacttctgcggcaaggccacgtctttcagccactcttcgaagtcttccaccatctcgatgtggatcacacgagactgcatggcagtagacagagggttgacgatggcccggtcagtggacaggttaccggcagcagctaccagacagttgtcgtgcagcttgtgttgcccaaccatgcggtcgaggatcagcttgtaagcagctgcttgggtgtctttcttggccgagttgaactcgtcgaggaagatcaaccagccgctgtagcctttggggatctcggcatcagccaatgggaacagctcacggaacggagcgaagtaggcgtagccatccttgaagtcaggcaggccggacaggtcttccggtgggctggtgctgagccggtgatcgatcaggaacaggttcagctctttggcgatgctcgccatgatgctggacttgcccagaccgggagacgactgaaggaacggcaccagaccggcatagagcacgtcgagtacgaactcacgagcctgtcgtggggttgaacggtacaagctctgggcattagttgccatgtcactcttcctttgcataagggaacggatctgggtattgcttacgcagatcgtcgaagatggaaccgaagctccagctgaagaaaccgggagagtagttctccacggtttcgatgagacggccaacatccttctgttcgaaggtgtactcctgttggccgagatactgcggcaggatggagccgacatcagtctgctccacgagtgctgccacccgagaacacgatggagggtcagtgatgtactgtctcccttggttcagtgggatcatcccttctccttggcccgttgggcacgacgtttctggttggttttgtggctgaccatctccagatggacagggttgcagcacaagcggttgttgcacttgtgatcaatctgcttcttgccggggatgtagccgtaatagtgggtgaacaccaccaaatgaaccgctacggtttggctgttgagggacatgcggccataaccaccacccttgccgtcacccgaatcggggccggtccagatgtgacatggacttggttgcccatccacggtgtagccaaggtctttgaccatgacacgctcgtagatgcgaaagatgatctcctcccgacgagatacgtcgatgatgtccccaacatcaggcggaagggcagcggtcactgttgaacttccttccacgggatcagcttgtcccgtgagcgaaggaatgcagggtcgcactcgatgacgtactcacgcagctccacggagccgaggtcaatgcacttctcagcgatttcacgctcgatttgttgctctgcgaccacgtaggtagcacctataacagcagcagtccataaacagaataacgcgaagttgtccatgtgattctccttgattcaggaaaagaaaaccccggcacatggccggggtctgattggtttttaaccccaaggaagggctacgtggcttcttgagccactactggctgtttggggatggaggcctcatagtcagcccggatcttagctacccaagcatccatgaaagcggcaatggcctgtttgccctcagcagtttcgaggaaggccgggatgccctgccatgcctgagagacgaagatttgcccctcttggttcagtgcagcaccaatggctgctttggtgcggtcgaacattgccagttcagccgacaagtcacgtcccatgagttgggaaataaccggtaacaaactcttgatgtccatttatggttccttgctttggtgggtggatgcctcaagggcatcgcggattcccttgctgatgttgccatcaccaagtttcttcgcttggcgaatgtgccaattggggagacgtgctgatacacgctggaggggttcgtcttgatcgctgtagacctttggtcgtcctactgctcgttccatgactgtatttcgtctgacaaaggaaacttattatggccccgtcgaaagacaaatctccacccacaggaatcttcccatggacctgtctactcacgaagctgcatcgcagcatcgttacgaaaatcttctcaaagcaatcgaggaacccaagatgagcgaaaccaaaaacttcttcggcactgacggcaacggctccaatgctggctggggtgccggtgttggtggtctgatcggtgctgccatcggtaatggtggtggcctgttcggtggcaacaaccgtgaaactgccactctggatcaagtggacagccgcttcaatgccctgcaaggccagctgaacgccaaccaagtcgaagatcgcatcgccgatgtcacccaagctgttggcggttcggctgctgctctgggtctcggtctggccggtgtcaaggatgccatcattgctggtaatgcccagacccaactggctctgtgcggcctcggtcacagcatgcaggctggcttcgcctcggtgaaccagaccactctgctggagagtgctcgtacccgtgagctggctcaacagaccgagatcaaccgtctgctggccctgactgcccagcaacactccgatgcgggtcacgcccgtacccaggtgctgctgaatcaggtcatctccgcaaagtaactccgccatccggggttaccgatctgagcgacgttgttgctcagctcacccggatggcagatgctgctgttgccagcaacgctcaagtggcttcggtcatcggggctgatgctaacggggttgaccgggttcgcaccgaaccactggcaccgtaagccgaaaggcattgagaaccccctcttttagggggttttcttatatctgaggtaaggaataatgaggcatttccccattttaattggtgactctttgccacaaagtggtcaaccagttcgtgaaccatatcgggtagtttggaatactgccgtggtttacaacgaccagcagcagtatttcaaacaacaacaagaagggcattttaaatcttctattctgaacacagctatactcactgatcatgagcctctggattttgagcccaagatgctcatgcttgatttcctgcctttggacgttaatctgacgggtttccctgtactcaccgcctctcgtcctaaataccctatcgttggtatgcgtgttaaccgcatccacgatattgcgaatgcggataggcgtaacaaacttcctaaagtattccagtctcagttcaccagtaccacagttttcgaggaaatggactactaccgttacaaccttgatgcagcaggtacaaagtacctttctctccgactagtcaggagtgccgtaagtcttcgtgcacgtttacgctactgccttgacgggcagactgtaatcaacagtgcgtatgctgagattcctgatgctcatagtggcacggcatccactgactctcttcgactcattgtttttggtgaccgtctggaattccacttgagtgacccaggagacaagctcttggagctttcctttgtcggtgaagtggtgagttcctcttcttcctttttggaaatgatccgtgaagatgacaaggaagatgggcaggatgtgcctgtactgtatgccattgatggcctgtacgtatacgatgggtattactaagtaaaataaaaaagcccctcaagaagaggggctttttgttggtgcctgttacggcttgcgtggagtggtccacgcctgcaccggcaggaaggtgcggaagtggctgttaacgatgcccacttcaacgatggtttcgccatcgccggtgaactcgaactcccacttgccatcagtggcacccgaacgggtcacttcgatcaggtcagggttttcggccttgaagtagtagccgtccttggtggcgtcggcaggcagaatggtgaagtccagcttgatggtttcgccgggcttgacgtaggtgtcggtgttgttgaacaggaagccagtcggcagcacgaaggtgccagcgttggtcagcttgatcttttgcatgtcctgaatgccatgcttggtgtacagcagctcctgcacgtggctgtagatggcgtggttgatcggcagcttctgggcaccggacaggttgtccagatcctcgtgagtcaggtcacccagcagcacgtatggagcagccggagcactgtcactggccagacggatctggacagtctgcatcaggttgctgtcacgagtggggttgaagtagctacgtagtttcattggttttcctctgatcagaaaaaataaggccaatccccgaagggactggccgtagtgtacatcaggacagggcatactctgacatcaggatgtcgtctgccaaagttgggtctagcttaccaatctgcaccttgtggcccatgagctgggacagcaggtcgctgagcatgttgctcttggcgatcaggtgcagttgcaggcggtactgctgacgcaggtcattgccgtagttcggcaggcagcggaagcagtcatggatggagaacacctcgaacggcttggcaggcaggctgttcagcagttcaacgatgtcatcgacattgaccagaccgatagtctcagtggtcaggtgatccaagatacgagcagacaggtagccagactgctcataacgctcccacagcacacgcaccatttcaccgtcttcgccgttgtcatccagatcctgcggtgcagggttctcgatggcataacggacgcgggcaatggtcttggggttgtagttgcaacggcgaccgatctcacgaacgatcatgccgtcgatgctgtgggtggtgttggcagacagtgaacgaccttcttgggtcggacggttcaccttgatgcccacgtcgaagtgctcaccattgaacagcacagtgctgtagtcaacgtcgattaccttgcagtggacgtggaagttgtcaggcagtacccacgagtagatagagcgggtgctatcccacatgtccttatagtacttgttgagttcccatacagctgggcactcttcttccatcgtctcgtggaacttgacgagcagtggcccgttgccgaacacacgcttcgggatggcctcgctgttgtacaggctggtcatcactgcggacttcaccatgtcacgagtcacacggccttgctgaccaaccttggccagcatcttcatgtagatctcggtgtaggcgtcagcacgacgaccgatgttcaccacgttgcacagcatggcagcacggcggtcgccagtcaggcaggccagaatctgcataccagaggcagtggcatccagagcaattgggtatcccgttggttcgctcttttgaacagcgtcccatgcctgaacagcagcgaagtactgagcaggtacttcagctttattcaccatcatgccgaggcagtgtttgtggctttcaaaccactgaagccggacttcccagtcctccttgtccaagccaaagtgattggcgatgtccatctggaggtattgtttgccggtgaattgttgagtttgcatgcttcttctcctaatgagtgcgtctttgcaaatgagggattattcaacgagttctttattagcgaactccactactgccttgttccaaggagcaccttggtagttcacgtggtagccttggcagtaactgcgaccacgtttgtcatacttgtgtagcaagtggaactcgttcttgtgctcagtgatgatgtcaatcacctctttcgcagtacggtcatacttttcaaacgcctttttacggcgttcaaagtcttcccttggttcattcggtttgggtttgtccaagcctttccacttgttcttgaccatctccacaacagtgaagttgattgcgaacttgatgcggttctgcctgttgatatggtccagacagatatcatcctcatggtggttattcttgaggatgaggctgccaccggtgttcagcatgcccgtatcacggttgcatttgacctttcgtggcatcactaccattggcagtggatattgaaaacggtccagctcatcctgcacatcttggctgatagttgccttgacgatgaacaggttgaagtgtggcgaccaatctacgatgtctgccacagcacacttgtacagcatgtcagcagttgcctgcggatcatcaaagtgcttgttcataacacctaccaaagttggcaggtcacagcgtttgtgcaagttcatctgaactaacaaatcgaagccgaaccccgttgggatatcattggcctcgaagtaagcagcaaagtcaaatgtctcgcagttgatgaactcactcttgatgcgagtgatcagttggttcttgttgaacaacacttccagctcacgctggtggttacgcagattgattgcatcttgagattcattagtcatctcggcttccttcattatctggttgaggttgtgttacttcacacgtttgagtgtgttgttttgtcgccagagctttacttgctcagacagacgcttgtgtagcaaataccagtcgtatgtgtattctccaactctcagcaacttctttcgaaagtggttaatccagtactcattatgctcacgtgagtacatcacgcaccctccacaaagtagtcgtattcttcacccaagtagggtttccacttgatgtcgaacatgcagttctttggggcaccaacgaacatcggtgcaatctcagcatccttgtaaccggcaaggccacaaccaatgcgagtgacaaagaagttgagcttgcgtttgccagtagcgaaggccaagaagccagccacgtaggcattgatcatgtctagcggcaaggactgtatgtcctcgttcttggttggaattgcaaagctatcaccatagtggccatagcccttgccatagacagcaccacactttctgtaagcgtgagctgctgcaccggcaccatgaatgccagcttcgttggaatcgaacacgaacactttcttagccattgacttgcttccttggtttggtgacacggacataacggatgtcttgatggggtttgcagcgagagcaatcgcaatgagtcatgctcttgccagtggtacggcagacgactttatacacgtagactccaacggtagtcagggtaggttttggccacggccttgagcagcacatcgctgatcacatggccatggcatgcttgtggagcacagaagcattgcagtttcactggtccatcaatggccagatcagcaatgcgttgcaactcattgatgacagtggtgttgccttggtctatctgctgttgcaaccagacctcgtatttctcaattaccacgtcacgtgtattggcaccttgaatcgggaatggattgcccaatgggctaccacgaccaatgtagatgccagtttcaccatggtgcttgttcaccacacgcaggtgcaggaacttctcaggcctgttgagccatgcctgttgttccttcttggttcgacatttggcacatttgccatctgcaccacagtgcccacgtttacaacgacattgcttgctcatatttacctctaacgaaaccagttattgaggatttgggccagagccacggcttggttgatgctggtgcgagcgaactgatcactgagcttgttgccattctcagtggccttgtcattcaactcggccatcaggtcgagattgtggattgcccacagttcccacagatgcaggtagtgatccttcagctgtgtctcactccagtcgatgacaggtggcttgcctttgcccagtttccagttggttccaccaatgtcatagcccttgatgtcacactgataccactgttcaatggttcgtccatcaggcatggttgccaccaatgcactgaagcgttgatcaccagcagtactgcactcgtagccaccaccaacattggcacgcacccagtttgggctgtactcacaggtgctggtgtagatctcaacggtgtcagttgacccgttgaccagcaactcagtcacaagctcacggccatggttgttgttccagtggaacacttgcaaatcaaaaccagcaccaccttgagagatgatggtgttcagttgctttgcagcttgttggactttcattccagctccctcacaattatgtctagctcgaccacacacacgtcttcaagacgacgatgcttctgtggtctaatgctgatcttgtcgagtacgaagtagcatgggccagaagaatacggatcgtctggcccttcccacccaccatgccctttgtgaatgcccttggcccagctacgcatggcttgggctgcacccttgtagctcttgaagagccgaggtgtcttttcagtgattgggcacaactcagctttggagttgctgcccttcacccatggcagatacagctcgccatgaatggacttgacggcgaacagtttcatgatccctcctatttatctctatcgaggcaatggtacgtggcaacggatggcatggttggccatgtcccacgtcattttggttccaccatcagcaggcacatcaccctcgccgaatgtgaaggcaatcatgtgtgtgcattcagcagccaccagtttgttgcgattggccatagctgcataacctttctgcactggttgagtggtgaaggacacactgttgtggctcaaagcctgacggatatggtctatcgaatcgaagcccatcttctggctgaactgcttgtgataccagttacacgctgccccactggttccgtactcgcctttgaagcagtgacgatcaaacggagcaggcagatgtagatgcagttcttttaccagatcagtaccaagtgcccagatggccacatggtcagcccaagcagcaccaccactgacaagaatgtcatcaggttgcagctcttcagccagagtgctagtcatgaactcccaatgagcaggggtcatgggaatggttttgtcacgaccagcagtgccaattacagcaatgattcggctcattggatcagtcctttcagttggcgagtgagtttgaggatctgtttgtcagcttcccatcgtgagtagatgtcagcatgaggcagcccatcgatgtagcggatgcgttgcatgatttgctcagccgtcagggtcttacgcttgaagagatggaacattttgttcctcctatttatctctaagcagcccttgattaggttgagctgtctttagtgaattgggtgtggttttgttctacttaccatttaggttggagtaggatttgttttaacttcggtgatggtgatgttcatgtactggaagccacgcttcagggccatctcattcagctggtagctggcgatgacataggcatggtcacggtcaagtgcatctacttcgatggtcccgttgtagataccactctgccactcaatacggaattgcttgcacagatggagggtgtgttgagctgcttgaggcatcagtctatcggtcatgaatctatcccctttgggagcctatcgaagttaaagcccctagtgcccttgcgggcaccagaggtagagcggttagaacgacagcttcttggcgaaggcgttgttgttcgggtcaacaggtggagcttcttcgtttacacgacgcagctggatttgcaggttgatcaccgaggattcgcccggcttcaggttctgagcgtgggcaaccagttgatcgagcaggtcgttgcgtgcagcttggaactgagcgaagtcggaattgcgggagttggtcttcaggtgatcctgagtgtccaacgggatgccttgaggcaggctgatgaacaggttgttgccgtcgtcgtcttgcacgtcggactcgtaaccgatgttcagccagtactcagctttcggacggtcagcagcaggagtagcagcgttgttggttttgccgaaggttttcggagtgaaatcgatggacatggtgaatctcctaacaatgggatgaatgggcggaattgcccaagagacgcgcagcgtcttagctattgcgagtgcaactttcgtgagctacggagccaactgcaacaatggtcatgagtccaagccagtttggcaggtgggagtagaacatagcaccgagagttacaccgatggttactccagcagcgagcagagtcaggatacggaagtacgaagtagtcatgggtttaactccaagtgttgggtaagtcagttgctagcaaggtgagagagcgaagtattgcggtgacctcagacaccagacatgcgaaggattgcagcggatacaccagagttgatggcccagattgtgaaggcagcgacagcgattggaaggtagagatagttcatgatttagactcatcttgagggtacacacggatgtgcatacccttgagggtggatttagggttgagcaggagtacgagtagcgttgagtttctccagttgttctggagtacggagcagggactcgaatgccttataagcagactcgtagtggcgagcatggtcagccgacttggacatgaacttctcagccttgagggcagcagtagcacggtgctcagcacgttcctgaatgaggttctcgatgaagtcctctttgtcagcgatgtgacggatgcgttgctcatcagcagccttgactacgaatgcgttgagcatacccactgcaccagtagcagcatccagtgttgtggtaacagtggtagcagcagcctggacagagccaaggacagcaccgaaggtaagacgagtggacatagtggtaactcctagtgattgagggcgaagatgcccaagagtggcgcagccacgcactagcaagctaagtgggggtagggtcgaggtgtagacagtgtaataccgggggggtacttggcctcgtggccggtgtagcggaggtgtacccctcaatggaacatgcctatcaacattttccccatgcaaaaaattttgcagcactacgctgtctatagcaaagatagatctatttaggggaggggctgagcccctttctccttggttctaacgccccaaataaaaagcccccggttcctaaacaggccgggggctagtacatgatcaatccacctaaccggcaatccggctggaacacccgcaggtgctaggagcggtgaacctcatgctgctgctgttacatacccaccttcagctggggctgtgtcaaaaaagcatcgtcgcagtgcaagacataaattagacaagtcctgcattgctgtcaaattctgtttcggtcacccggttcccacgtcgtgtagacggaaccggggtaggtgtccatccggtacttcctcatgccgatgtcttgatccaagaactgaatcttgatctcacacccgtacaccagctgcatggcccagaagaagtcgtactcttcctgagtctccacgagcatgaggttcttgggccgggagtagatttcctcccagtcttccaccttctggtcacaggcaaacttggacgacttccagacttctacgttcatagcaggtgctggatagccgagagctgggcagtggactgcgaccaatgggccttctccctgacgttcttcttccacctgagatcaccctggtaatccatcatgtagtcgaggaaccgggggtcagtgcagaagatcggatggggaccgaggtacgctttcaaggatttctctttgtactggtctggccagtacccatcatgcagctcttggaagtcaacgaggttcacgctgcccaagataagttgcatagagaacaggtaggcccgctcttcgtcacccatggcgacgactttggtgttaggcccccagtcgaacacctgatccaaggtccagaccttgctgtccctgttcaggtcgttgaagtagtagaaatgctcagcggtcatggcgttgtaccgaggtgcagaagtaaattggaagaaggtctgattgtttggtttcgatgaatgtcttgttcccatctaccgacaacccggcgtagtcagttttgcctcgttggttccactcatcccatgtcctgatgtctacctcccgaccgaacatcaactgcatggcagtgaggtagtccttctgctcttgagtatcggtgaggatttggaacctgacgttgtaggtgaaaacaaactcaagggggatggcaaagttaatcaacaccccattgacgtactgcacaagcgtttcgatcattggagactccttagaaatgagttagactaaagggagtctaaaggtcaaccgaccttttatccaccccaaggaacccatcaatggaaaaccaacaccgtctagttaaaggctaccgtgaccttaatcagtccgagatcgacgccatgaacagtatcaagctcgctgagcaggacattggccagctgttccagcagatcaaggccatgcccggcgtggatcaacgtgccatggccttggccaagaccggcttgcaggaagccttccattggttcatccgtgccgtggccaagccgcttgacgtgtacgagctggtgcttccaccggaaaccttcctcgaccgtctcaagcgtgagcgtgacgaaaccgtcgagcgactggacaagctgaagctgttcctcgacagtgagatcttccagacgctgaccccgacccagcaggaagacctgaagttgcaggccgaggtcatgactccctacgccttcatcctgagcaaacgctacgacgatgaagtagccaagcaaggctaagtgaactaaggaggggactacggtccccttctccacaaaaggaataacgaaatgctgaccgtcgatgacgtaagccaagcagtaccagcgaacctcaagtcggcagtcactccgcagttcgtcgccaccatcaacaactgtgtggccgacccggagattgccgaacaggtacggaacaacttcatctcgtttgcctctgtcctgcgtgacggcaagtacaagatgcaggactacctgaacgccgtgacctacgtgtcctacaagatgatggacatgagtaaccacgacgcatggtgctcgaccttcccccaacgccatgcagcactgatcgcagcaggtaagggcaagaaggacatcagctcccacgtctccatgtactcgaagggcaagctcgtcgctgccgtcatggaagccagcttcatccctacttggatcctcaaccgggatatccaacagaaggcgatcaaccgtctggctgacttgatgatgaacgctcagtctgagaaggtgcaggctgaagctgccagctccctgctgactcacttggccaaaccgaaggagtccggcccgctggtgaatatcaacatgaccgagacttccggtatgaacgagatgaaggacatgctggagcgtctcgcttcccagcagcaggaactcattcgtaacggtgtgaccaccaaggaagtggcaggtcagcgtatcttcgagaacgccca

SEQ ID NO: 15 - DNA, 76014 bp, unidentified
  misc_feature 1..11: note = bacteriophages nucleic acid sequence
  source 1..76014: mol_type = genomic DNA
atgaacgtagatccgaaaactggactgatcacccagaagctggatgaatggttggatggtgtggactactcggtgctcaacagtccgagctacatcccatccaccttcgccctgaccttcatgaactggatcaagatggtcaacggtgacgtgggggagagccacaaaactccccctgttcacctgaaaatgctggacaagatcgtggatattaacccgatcaccaaggccgtgaacgcctacatcgccaacctctgcttccggggtgcagccaagacgactctcttcatggagtacttcgtcctgttctgtgcccacttcggctacatcccgaatttcgggaaagtcgaggggatgatctacgtttccgactccatggacaacggtgtgaagtcggcccggaagaacatcgagttccgttacaagaacagcgagttcctccagtactggatccctgacgccaccttcactgacaactaccttgagttcaagaaccgtgaaggccacgtccttggctgcaaaatgttcggtgctaagaccggcctccggggtacgaagatcttcggtaagcgtccgaccattgccattctcgatgacctcgtgagtgacgatgactccaagtcgaaggcagccatgcaggcgatcaaggacacggtgtacaagggtgtcaaccacgcactggacccaacgcgacgcaaggtcatcttcaacggtacgcctttcaatgtggacgacatcctcatcgaggcagtcgagtccggtgcatgggacgtgaacgtctggccggtgtgtgaagcattcccctgcaccaaggaagagttcgtgggtgcatgggatgaccgtttcagctatgagtacgtgcaggaacagtacgacatggcagtgaagaccggtaagctcgcagccttctaccaagagctgatgctccgcattacctcggctgaagagcgactggtacaggacgaagagatcggctggtacgaccgggccgagttgctgaagcacccggagcgttacaacttctacatcaccaccgacttcgccacctctgccaagcagactgccgacgactcggtgattgcgagctgggcctacaacgccaaccgggactggttctgggtggacggcgaggcagagaagcagacgatggagaagacgatcaataccctcttcgcccacgtcctccgttacaaacctcagcaggtgggtatcgaagtcaccggccagcagggtgcgttcatcacttggctccagcaggagcagatgcgtcggaacatctggttcaacttcgccagtgatcagcagggtgggcaacccggcatccggcctgtagcggacaagctgacccgcttcaaccttgtggtcccttggttcaagatgcacaagatctggttcccgaaagagatgaaaggttccaagattgtgggaaaatatctggagcaaatccggctggccacccagtctggtctgaaaggcaaggacgactgcatcgacacgatcagccagctggcctacctcaagccatgggttccatcggaagctgccccgcgaactgaagaggaactgtccatgtggcaggaccagttcagccagcctgaacccaaccgaatggactcctacatcgtctgaggccttatgcaaatcaaagacttgtaccgcaacctctcctacggggtactgaaaaacctcaccatttctggtgaggggagtggtgacatcatcgagaaaggccgggggtctgtgatccttgctgccaacgaggcgttgctgcgtctgtactctcgcttcctcctgcgtgagaaggacgtgctgatccgtcaggtggatggggtgaccaactaccatctgctgaagcggtttgccgagttcacagaaccacgggtggaacgacacacctacatcatggacatgggattggagcccttcgaagaagacgtaatcaagatcatcgctgtgtacaatagcgacggttaccagatgccgctgaatgacaacgaagctccatggtcggtgttcactccgcaggcgacggtgctccaagttcccaacccggaaccgggcaaagccttgtcggtcatgtaccaagcacggcacccggtactggaagctgagaagctggatcaacccatcgagctgccagatgttctgcacggtgcgttcttcagctacatcggctaccagatctacaacgacatgggtactgccgagtccatggccaaggccatgaacctgttccagaactacaccttgatctgtgatgaggctgtggcgaacgactccgttcaaaccagcattaccacttccaactcccgctttgaaaaacgaggatgggtataacatgcgtccaccattcgacccagtaggtgggccggacacgctagtagacaagatgctcggcaacgcttacgacaccgtaaagaccgttgccttgaatctggcctacatcaagcacgtatcggaccagctcgaaaacatctacaacgtcagccaagaactggtggcgattcagaatatctccgacaatctggaagatgttcagaagatctacccctttacccaacagatcgcagcagttgctgccgaactggacgaggtggtggctgtctccaacaacctgacccagatccttgtggtctaccaagcactaccgattctgcgtgaacttcacgctgaaatgccggaactgctggagatccacgcgaacctcggtcgtctgattgccgtcttcgatgccttgcctcaaatcaagaacgtcgaatcccagctggcaatgctcaacagcatcaacgacaacctcagcgacttgctggtcatcagtcagaactccagcactctggtgcccatgagtcagaagctcactgagctgctggatatccacagtaacctgacggccattctggctgtgcaggcgaacctgactgctatcaacgcagtggcgactgatatcgccaaggtgaacaacgtctcgaacaacatgacggctgtgaccagtgtcagcggcaacatggatgccatcgccaacctcaatgcggacatcgctgctgtggttgccgtgaatgcccagctggctgctatcgagaacgtgaacgccaacatctcggcgatcagtaacgtcaacacgaacttggcctcggtcaacagcgtggctctgaacatgggcagcgtcacgtcggttgctaccaacatggcagacatcaacgccgtggctgatgcaatccctgacctgaaggctgtcctgaagaaggaagtggttgtcggtgcagctgactcggccaccaacatcccgttggctccggccaacattggcaacatcttcggcatttccgggatgctggtgggcactgatgggaacgtgtacttccccgatgcccacttcaactactacgtgtccgggtccaatctggtcgtacagatcaccaccggtgccccatctgcaatggaaggcggtactgcacgggtggtcattcattacgacccaacgtaaggaactgtcatgagcgaccgtccatatgctccactggatgcgttcactcacccacgggaccactcttctcgggtggtccctctctgggtggatgggcacggtccatacgagttggccctgtctgaccatacgatggcattcggtggtcggctggttgataccccttcggacccaatggtcttgaagctaaccaacactggcttccaacctctgaacgtactgtcgatcaccgtcgaaggaccgttcaccatctctggcttcgaaccccatgagataaagggaggtggtggtgtttccttggttccagttgtcttccggcccccggcgtttggggtacactacggcaagctggtcattaccacgaaggaaggtctggtcaaggaggtccggctccttggagccgggatttgggactacgtgaaccaagtggaccaagcaatctctgacctgtggtcttttctgcaacgggctacccgtccagcactgactgaatccggtccgatcattgacttgggcaacactggtgtcgagttcaagggagaggtcgctgttggcgaagactccactgacttcgactatgtgatcgccaacgccggtaaccagcccctcattatcgacaatctcactgtgaccggggacttcgagatcattccatgagcatcactattccagcgtttggttcgcacaccatcaagttgcgattcaagccgacggctgagggggtacgtcagggcaacctgacgttcacttccaatgcaccgtctagtccacacactgtcaccttgcttggttatggcaagtccactggtggtggtgggccagaccctgagccgggcggcaacatcacctacctcactgccgatgggggcaagctgcgtgacaacaagggtgacggcaatgttgtgaccctgaagtccatcaactggtatggccttgagcagattgggattcctactggtgcatggtcccgaccattccgtaccaaggtggtcaacggtactctgcgtgaaggcatgctcgacgagatcaagcgtttgggcttcaactctatccgtctgctgttctctcaggactgtacgtgggatgggtacgcccctcagactgccaatggcttctggaacacgacgtacatcaacccgaacatgaacggggagttcctgaataaccccactcaagaaaacccccaagcggtcaagtccaccatcgagatcatcgacatcttcgttgcatggtgtgaggaactggagctgcgtgtcatcttcgacatgcacaccctggctccagatgacagtaacgtgctggccaccaacggtaagtggtacaccactgcatcgccgggcctacccggtgcgactgctggacagaaacgggaacctcgtaacgaggctcaagccattgctgcccacgtgttcctcgccaaccgctacaagaaccggccaattgtctgtggtttcgacctcatcaacgaaccgcatgcttgcacgtgggaccgtgaccctttgactggtgtactgggcttttacgagcgttgtggtaaggccatccatgccgtaaaccctgacgtgctcatcatctgtgaaggtgtgaccggcaacgtcgatcagaccccagcaggacacgaaaacgatccagaaagccagcagggcttgtacgactggagcacgtggtgggccggtaagctggatgacgccggtagcctgccggtgcagctcgacatccccaacaaggtggtctactcgccacacgagtacggtgcctacctgatgggtgtggccatgcaaccttggttcaaccctgaagaaaaagtcggtgccggttatgccggtctgccctatccgcagaacatgactgaagtctggcgtcgtcagtggggttacctcgccgaggacaacattgcacctgtctggattggtgagttcggctcctacctgcgtgttggtggtaacccagttactggtggtggtgctgactactctgagatccatttgcagaaggacgaagcatggctgaccaatctggctgcctactgcgacctgcacaagatcagcttcgcctactgggcatggccaccgggcggtgaccctgacggcctgctgtctcaggaagtgggtggtgcatggactgctgctcagcagttcaaggtggactacctgtccccattcatcactccggtgcctcaagcacaagtgactgcttccccttcgacggttgccttcggtgaacggcagattggtagcagctactcgatgaatctccagctacgtaacatgggcaacactccggtgaacgtggtgtcggtgtcttccggcacgggcttctctgtggtgccgagccatgggactgtgcctgccttgggtgtgctggatctgactgtctcgtttgctgctctgactctgggtgctgccaccggcaagatcaccgtgtcctacggtgtggaccagaccattgaagtcccagtcacggccacctgcgtcaacaaagatgaaccgggcgtggaccctatcgtcatcgacctgccgtcgaatgcgtggggcatcactgctgtgggtgactccctgactgaaggtggtgcctacttccacaatggctggctggccaaggcctgcttctacggcaaccagtacctacgcgaccgcaacaacttcgctgtgcccggttccactgtggaacaggcccagacccttcagctgccgaacgttctggcaatgaacccaccaccgaagatgtgcgttgtagcctctggcaccaacagtgtctaccaaggtgcggctggggtggagaagatcaaggagatctgccagaccctcattgctgcgaagatctacccggtcctgtggacgctacctccacgcaatgacaccacgtccatggacagcaacatgattgcgtggaacgacgccatcaaggcctaccaccgtgagactggtatccctctgctggatgcgttcgaagctatgcgtgtaccgggcagcatgcgtgctcaagaagccctgatgaacccggatggcctgcacttctccaactacggctacaccgtgttgggccgctacgccatcgacagcaaggctttcactgctgctcccactgacggacagattgccctgcctacctctgtgggcggaagtaacctcgtccctaatccgttgttcactggttctgctggtgtgtctactggcctgactctggcgactggattcactggtcaattgcttccagctgctgctggtaactggcagcggatcattcgtccggctggcttgactggcaacaacatcaccaacaccattgaactgttcgctattcctgctggcaaatccctgtcccttgcatgcaaggttcgttggaatgctgctggcttgaagggtggggtgaacatggtgcggtcggcatggcaactaggcatgcaggtcatgttcactgaccagagctgggctgacttcccgaactcgctcttcgtagtagtgggtccacaaggtgacgatgtggaagaaggaaccttctacatgcaactgactcccccaactggggcgaatcgactgatggtgcaactggtgtctttgtccaacatggtggaggcccataaccaagacattacgttcgacatctcccagctggctgtggtcgaaggacaatttgctttcaacagcatcgacccaagtccaaatccaacggataatccaaacgcattgcgggactcgtccaacgacatcctgctggattccaactctgaggcaatcgagagctgatatgggcaaactcaatacttaccagctgcaatcgcagctggctgccactctccaactgattggcatcattccgggcgaaggctcggctttcgagactgtgcggctgtcgaatgctgcactcgtctccttcatccagcaatacgctggcgaagacggcaatgatggccgtgagatcgaattgcgtgcaggaagcaccgacattgaatggcgttacgccggggccacctcgtggactgccctgatcgccatcaacgacctgaagggtgcagctggtgaacaagtccagttgcaggcgaacgccacgcatatccagtggaagtactcgtctgcttccacgtggaccaaccttgtggcactggccgacctgaaagggaccaacggcaccaatggccggactatgtggtctgtgtctggtgccccatcctcggcactcggtgtggatggtgacttcgctaacgatgccaccaactccatcatgtacggaccaaagacctctggtagttggggtgctggcaccagctacaagggtgcgaaaggcgacaccggcaccggcctgaccaaccgtagtgcatgggtttctgggaccgtgtacaaccccggcgactacgtgttctctactggttcggcgactgccagctccatgtggatcctgaacggtgaagtgtcctacacctccaacaccctgccgaaggacgacctgacccactgggtggagtttgttgcaccggctggtgctgatggtgaagacggcaagtccgtggaaatgcgaaagactgccaccgtcattcagtggcgtctggtcggtgacccagcgtggactgatcttgtgacgctggcagacctgaagggtgctgacggtgaggatggcaccaatggcaataccgttctgtccaccactggtgctccttcgtctggtttgggtgctgatggcgactttgccatcgacgtgaccaactcggtcatgtacggccccaaggctggtggtgcgtggcctgttggtgtgtcgtacaaaggtgggccgggtgacgctggagctgccggttccaagtggctgactggttctggtgagcctgactccggcactggtgccgatggtgacttctaccttcgtgacacgggtgacgtgtacgggccgaagactgctggtgcatggggtgctgtggttgcctccttgaagggacccaaaggagacactggtgatggcggcggtggcggttcgggcgatgtgaccaaggcaggtaacaacgccttcaccgggaccaacagtttctctgctaaggtcactatgtctaacggtttggatttgagtggggtctttaactacgctggtggcaccatgctctacagtggtgtatcccgtaaggccggtccatcggaaggtggcactttgtccccgactgctggtgtttcccagcaagtaatcaccatggctgctgatgttgctgctgcaactatcgctttccccaacgattccacgttgggcattgagatcactatttatctggagaaagccattacctccgttacttacagcggtggcaccatgtggggtggtagccaggcagttgcagtagttggtgccccatctactctccgtccgggcgggcacaccttccgattgctcctttctgaaacgccagcctggtactacatcaactaacctctagcctgttagacttagcccggtcagttccctgaccgggcttttttattcacagaggaatcctcatggcttctactcttccaccactcatcaccaccgaaggactggtcctcaacaaccagatgccgggtgaaggtgctctgggtaactacacccccaagggcacggcatcgtctgaaggcatctcccttctgatgcgtggcatcctccgggcagcacatgccacgggcgataccactatgaaggagtatgcaaacttcctcttcgatgccgcctgcaagtacttcttcaagggccaacgcccaccggctgaagctggcgaaggctggcatcacagctggatctgcaacggtggtgctgctttccaagtgcgtggtccactggctacttctggtgatctggccttggccgggtacatctatggccgtgatcctgaatcgtccattcagttcaccaatggggttggccagctgaacccggctccagacatctgctaccaagtggtcagccaagatgctgcttttgtgtggccgaacgtcttctctgatctgactgctggtcagacctatgaggtggactactacatcgactccaagggcaacaaggtgttcggcactcagaagggtggctcctttggtcaaccctccattcctgctggtcagcacgatgatggtgctccgggcaagatcgtcctgaagactcctgtctccggcaccctcggtgtcaacttcaacgtcacggttcctgacgtggttgtggcttatggtgagctgtatgaagcatggcccatgtggcggaagctggcagatgaggaagtctcgacggcagctgatgctatccactggttcatcgacgcattccagcttggtcgttccttggatccagccaactccgactggaccaacgccctcaaccgtatgcaggaagtctgggaaaccacctgcaaccaagagtccaacagcaccttgatttttaaggccggagcagacggtccgtacaataacttcccgcttacttacagctatggctatggccgggacaacatcgacaacagcagcaccaattgggatgccgtaccccccactgatcgttacagtgtgcaacgggaaagtgatggctacgtgacttttgttatgcccaaggaagatgctgaagctgggacgggcctgccaattcgctatggtatcgccttcgaaaacaagccgttgtatctggagtatacgcaaaacagcacgctcgtcttggacagttactcttcggtggctcagacgttggacgtggtgattggtgatgccactgacaagcagtacacggccactgtgttgctgggtactgttcctgatacgccagtagaaattggtgttagtcagttcctgcaattccagcaacaacctggggatgcatcgggtacgcagaccggcgactggcatggtgacgaggacttcgttatgccagtgtacgatccggtgccgtggccgggtcgtcgtatggctaccgtgggtgactcgatcactttctataactgtgcccatatcgaccccaaggctggctccaaccgttatgaaaactatggctatggatatgctggctggtgggtcaatgctgaacaaatcatgcgtggccggaccatgctggaacatggtattcagcctaatctgactggtaagcaccggggcaccagctttgctgtggccggaaccaaggtgcagaactggtggttggcacaggacttcccagcctcgcccaacactccagaagtagggccgatgtacgctgccctacagtacctcaacaagtacgacatggtggccatgcttggaggcaccaacgacctgtcgggtaatgccccggccctgcatgtgctgaaccgactgaagcgtgcttcgaccgatctggccaagaatggtaagtgggtgttcctcggagtgatccctccacgcactcggtgggaactgcgaggttacacctacattgagcagactcagattctggaacgattgaaggaagtgaaccaagggctgcgtgactgggttaccaacgatcgtccaccgaatatcttcctcgtagactggtacgaccgtctgcttggaccgaacggccaagatcctgctggtctgcaatcccatgcctctgacccaaatggtcttgactcgctgggcaactaccgtgcagacgcccctaacttggtgttcttccacgatgggttgcatcccggtccagctggcgctcggatcatgggtgaagtgctggctgaggttatgattgctgccggtgttccagcaagggacaacaacaacacccttgggcctttgaccctcggtccaaacttgttgtcgaatccgactttcggtttcacctcgtttgacaccaccatcaacaccagcaactacaatcagtctgatatcggatgggcttacggtttgggccaacaggtcaaagtgggcacgctccacaacggcttcacgtatggcaaagtaccaaacaactggaagttctttaaggccaccaatcgtgaaaatgtgcctattggtaatggtgttgggggtgtctacgccaacttcatgagctacacgtatggtgatatggcggctgagttcccggctattgtgccttacatggctgacccaacttggcctgaaggctcagtgcgagtaactcttggggtacatgggggttcgccagctctgatcatagacgttgatatgcctgtgacgggtaacaagaatgagtctttcgtgttggtggctgacatccctcgccgtcaacatgggccatgggataactacggttacaatgggcctgaccaaaacatggtagtcatcaacaccacgtatttccccggagatatgctgttggttgagtctgacattgtatttgaaaacctcaatgccactctgcatagctgccaacaggtgctctacttctaccagaacaacccaggtatttcctttggttctaagctggcatcgttcggcaaccacccgttcatgtatccaccttcggacatggacaagatccggttgcacactaagaaccggacgatccaactgcgttccccggcgatccgggttcctcagacagaggcgggtgaaaccatgcagtatgctgaactgcggtatgagattggcttcgatgcctcagtcatgggtccgaaagggcgaatcatcatcaagaacccttccgtgcggaaggtcaccggaggtactccactttgacggcctataacgtatggctgcccagtgacaaattttttggctacaacaacggggtacaaacctcgttgtcgtaccagagcactggcggaagtaacaaactgctgtgccgtagcttcaccattccagacttcgagtctggttttgggatcacctacgaccagatcaatccggcttttgctatcactaagccgcccaagatctgttatagctcgacggctgacatgaccctagcaatcaaggatagcgatggctggctatggacggcgaatatgcctgctcaggctgtggtcaaggaacgaggctgggcgtggagccagttcatccttggttctgtacaggaaaacaccggggaacctccggtgtccccggcgactggcaacatcttggccttccagattagtggggccagcggttcccatggaccttctgggaccgatccagtcaccgtgcgactggcttatgtggccgggcgtactccgggcgtagcttcagcaggcaccattcgccaagtagtgttgaccgacaagaacccagcagcccatacatggaaggtgggaaacatggaactggtcaacggctctcgccgggaagtgaagtacattggtgctctgccattcggcctgcaaatgaacggtccccgtaatcgtctgtcgtcgttgccgtaccgtggccctatcgtggctggttaccagtcgggtacgccatgggtgcatgagaacaacaacgaaggattgagcggcatgctggacttcatgctggattcccagttgcagttcactgcccggagtccccagcgtctggtcggtccgttcatgcacatctacctgcaagccctctgggactgtgagcagaacggtgagatcgacacgtgggtgtgggatggcccagacggtaaccctgcatgggatggctggcagtaccgggcaatcgactccatgggccgtacttggtacgagatgagcctcaacccacagatgtcggctgagaacatggagaagatcgagatgatctgtacccagttcctcgactggctgtatcagtggttcatcgaccacgaggaagcaaacggtgttcccaacgactggcgaccaccaaactggacccaagggaacccaatgcctgcgtccagctacctcgatccgaagtacactggcccgtctgcccatgacgatgcactggcactgaaaggtgctctgttctctctgcttgctggttacaacagcctgaagggtcgctacatcgttcaccgtaccttgtcggctctgctgagtctgcaatactctggtgaggatgagatggatggggcattcactcagaacccaacgggctacgaggtctatggctttgaacagggggagatcttggaggctctggccttggccaaacagcacccggaactgctcagttccccgatgactgtcactgagtagcactttgatattgaggggatttacgcaataatcccctcggttttacttataaggaaaatccgacatgaccggggagtcgcttgaggtaaagatcgcccgactcgatgaacgtctccagcgtttgcttgacgagtccgagcttgctcgggaggggcgaaagcagcagtacgagaagctggagcaagtgaaccagacggttacccaactggagtctcgggtaaagggagtggaggatgggctgaccaaggcatcccccaccattgatgagttcgtcaacatcaagatgaaagtccaaggtgctggcattgtcggcaagtgggtttgggctgcgggtggcactcttctgggtgctctggctgtaggccgtgaggccatctttgcttggttttccaagtgatccggccaatcgagaactggagaaaggcatggaagtttgcttcagttcagtggaatgttgttggtatcctgtgcatgctgctcgaaattgtgcagcagacatggcaatcgctacccccggcgattgctgagcagattcccaattcgtctcacgtagccttggtcttgtttcttctagctacggtggggcgactcatcaagctgaaggaaaaacaggatggctcttcctaagaagacactaggtgcagcaacggcagcaatcctcgctgccgtttttgctatggaaggtggttacgtcaacgatcccaaggatcccggtggcgaaaccaaccatggcattaccatcgccgtagcccgagacttcgggtacaccggtcccatgcgtgacctctccaaggagacggccaccaacatctacgtcaccaactacatcaacaagccgggctacggtgagatcatcacgctctctccggcagtcggtcagaagatcgtggatgctggggtgaacaccggcacctcccgttcttcccgttggttccagcaaagcctcaactccctgtcgcgtggtggggtcgatttccctcaaattaatgtcgatggtaagatcggccccggatccattgcagcgtaccggtcgcttcaatcggtgcgtggaaaagtcaaagcctgtgagctggtcctcaaactgatggatgctcaacaggccagtcactacatgagcctgaccaagaccccacagtatgtgccgggctgggttgaccaccgggtaggcaacgtcccattggagaagtgcaaggaatgaacctgaccaacatcttctacgctggtgtcttcgctgctgccattgctggctcctatgccctgactttcaagtacgggcattttgtaggcagcatggaggtgttgaccgagtggaacgaggcgaatgttgagcgtgcaaaagcagatgccgagttccaaaaagaaaatgctgccttgatggcagcacatatcactaaacagaaagagctggaggaacaacttgatgagcaaggtcttcacttcgaaagcatgctcgatgctgctcgcagcgactttgctagccggttgcagctcgcagaaggccgagcgggagtatatcaacgacaagcccaaggcagccgtgctgagcaaatccgccttgcagagcatgcagccgaactcgaccgatctcttgaacagggccgggctctggtacgagaactcggggaaactgttagacagcgtgaccgaaccatcggcatcctccgagaagtaatcatcaacgaccgcaccctcactggtgaacagtaatgagccttgaccttgaacaacgagtggatggcaacgagttgccgaagctcactgactgggtgaatgaacccagtctgcgtgacttgaagttggacttcgagaacgcccaacagaaccactcgaaccagatggccaagatcgacaagtgggtcgagctgatgaaggtcaccggtgcgagcaagcctcagaaagtcaaaggccgttctggcgtgcagcccaagctgatccagcgtcaggccgagtggcgatactctgccctgagtgagcctttccttggttccaacaagatcgccaaggtgaccccggttaccttcgaagacaccgatgctgcaaagcagaacgagctgctgctgaactggcagttccgtaccaagctcaaccgggtcaagctgatcgacgacttcgtgcgtactgtcgtggatgagggtacttgcatcttgcgtactggctggcgtcggcacatggtcactgtggaggtggaacaaccagtctacgcacattacgagatccagaccgaagagcaacttcaggccttccaacaggcctacgagctgtctgaggaaaaccctcgtggattcgatgaggacgtggacccagcactgaaagaggcagtcacctacttcaaggagacaggcattgccacttatgcagtgcaggttggtactcaaatggtgccaacccagaaggctctggagaacaagccattggtggacatcctcaacccacgtaacgtggtgtttgacccgtcctgccaaggtgatgtcgaaaaggccaacttcgctgtcgtctcgttcgaaacgaacaaggctgagctgctgaaggaagggcagcgttacaagaacctcgactacgtgaactgggaaggcaacaccccggtcactgccaacgactacgcaaccactaccccggattccttcaacttcaaggattcgatgcggaagaaggtcgtggcctacgagtactggggtttctacgatgtgaacaacgatggccgtctggttccgttcgttgccacttggatcgggaacgtcctgatccgcatggagttgaacccgtaccctgacgagaagctgccgttcgttgtggtcacctaccgtccggtcaaacgtgatctgtacggtgagccggatgctgaactgctggaagaccaacagaacattctcggtgccgtgacccgttcgatgattgacctcttgggtcggtcggccaacggtcagcaaggctttgccaagggcatgctcgatcccctgaaccgtcgtcgttacgataacggacaagactacgagttcaacccgaaccagaaccctgccaacaacctcatcgagcacaaggctcccgagctgccacagtcggccttgaccatgatgaccatgcagaacaacgaagctgaatccctcactggggtgaaagcattcgctggtggtgtgtcgggtgaggcctacggtgatgtggctgctggtatccgtggtgctctggatgctgcatccaagcgtgagatggcgatccttcgtcgtctggccaaaggcatggctgatgtcttcaacaagatcatcgccatgaacgcagtcttcctcagtgaagaagaagtcgtccgtgtcaccaataaagagttcgtcactgtcaaacgtgaagacctccaaggcaacttcgaccttgaagtggatatctccactgctgaggtggataaccagaagtcgcaagatctggccttcatgctccagaccattggcccgaacggcgatccgaagatggtgctgctcattctggccgagattgctgacctcaagcgtatgcctgagttggctcagatgctccgtacctacgagcctcagcctaccccggaacagcagatgctccagcagttggagatcgagaacaagcaactcgaaaacgagaagctcaagtccgagatcgcactgaaccaagcacgagcacaacgtgagctggctatgaaagaacaggctgacctcgactacgttgagcaagaaaccggtactgcacacgagcgtgagatggacaaacaacgtgcccagtcgcagggtaaccagaacctgcaagtaactaaggcactgactactccacagaaggaaggtgagaagcagcctgacctgaatgctgctatcggattcaacgctattagttctaagttgaacgacgaacagccttcgagtactattcaacggaatgactctggcagccgacctaccaatttggggagcagccagttcaatccagccgtagatccggcactcaacccagccattggcatttaattcaaggaccaatcagacatgtctgaagtcgaacagaatatcgaagaactccaccagtacaaacgtgagcaacagactctggtcgatgctcgtgatcaggccattcgcctgagcaccaacccggacttcaagaagctgattctcgaaggcttctgtaccagtgaagccgcacgttatgcacaggagtcgggcgatccccagctgactgccgtccagcgtcaggatgccctgaacatggcacaggcttcgggccacctgaagcgtttcctttcgatgatcgtcgtcatgggtaacactgctgcccgtaacatccagcaagcggatgacgagatcgcccatgtcacggagggtggtgagtaatggacaagtccactgacattctcgaaatgtcggacgaggacttcgccaagctggcccctccagcagtaacggaggctccggcctccgaacctgctccggccactgaagaacagcaagcagctccggctgctgctgctgtcgaagctcctgtccagaccgaagaacaacagcctgctgctgctactgaagaagagcagcagactgaagagcaacagcaacaggccgaagaacagcaacaagctgctccggtcgtcgaaggcgaacagcaacctgctgccaagcctgatgctgctgagcaacaaccggctgccgaagagttcgactacaaggctgcctacgagaacctgctggccaagccgctcaaagcgaatggcaaagagatcaagctcaactctatcgatgagctggtccagttggctcaacagggtgctaactacacccgcaagatgcaggaactcgcccctcaccgtaagactctcctgatgctggagaacaacggtgtcgatgctgaaaagttggacttcctgatcgccctgtcgaagaaagacccggcagcgatccagaagtacctgaaagactccggcgtcaatcctttggatattgatgtcgaagctgaggcgacctaccaaggtggcaatcaccgggtcagtgacgaagaggctgctttcgccaacacgctcgaagacatgcaaatgtctgaggctggcaagtatgtcctccagtcgattcacggcacgtgggatcaggccagtaaggaactgctcgtcacccaacccaacatcatggagatcatgcgtcagcaacacgaggccggtttctacgaccgtatcgcggctgaggtggatcgccagcgtatgctgggtgcaattcctgccagtcaaagctggctgcaaagctacaagctcatcggcgacaagatggttgagcaaggtttgtttgcagatttgcttgcaaaacaagagcctgctgctcaaactccccctgtcgcagctgctcctgtggccacccgtgtagctgcaccaaagccgactgtcactgctgatgctcgtgctgcggctgctgctccaactcgtgctgcaccgtctgctgctaagaagctcgtaaatccgctcgccatgagcgacgacgagttcatgaagcaattcgaaaaccgtctctaagtaagggaagccccagatgctgaactataacgctccatcggaaggccaacagtcttccatcgaaggtgctggctccagccagatgaacaccttcttctggctgaagaaagcgatcatcgaagctcgcaaagatcagtacttcatgccgctgtcgtccaccctcgacctgccgaagcactacggcaaggaagttcgcgtctaccagtggatcccactgctcgacgaccgtaacgtcaacgaccagggcatcgatgccaacggtgtcaccatcgtcaacggtaacctgtacggttccagccgtgacgtgggcaccatcgtcagcaagctgcctgctctgaccgagaacggtggccgggtcaaccgtgtcggcttcacccgtctgcaacggaaaggctcgatccaccagttcggtgtgttctacgagttcaccaaagagtcgatggacttcgactccgaggacaacgtgaaagagcacctgagccgtgagctgatgaacggtgccgtccagctgaccgaagcggtccttcagaaagacctgctggctgctgctggtactgtcctgttcgccggtgctgccacctccgatgccaccatcactggtgaagtcaccccagaagttccgggcacttcccctgaaatcccggcctcggttgtcagctacaagaacctgatgcgtctggacaagatcctgaccgacaaccgtaccccgaagcagaccaagatcatctcgggttcccgcaacatcgacacccgtgtcatctccggtggccgtgtcatgttcgtcagctccgagctggcctccaccctgaagggcatgaaagacctgttcggcaacaaggccttcatcgagccgcagcactacgccgatgctggtactctgctgaacggcgagatcggttcggtcgatgccttccgcttcatccaagtgcccgaaatgctgcactgggctggtgctggtgccccggtcaccgataaccccggctaccactcgaccaacgtcggtggcaccgagcgttacgacgtgttcccgatgctggtagtcggcgacgactccttccagaccatcggcttccagaccgacggcaaaaccgtcaagttctccgtcatcaccaagatgccgggcaacgaaaccgctgaccgcaacgacccttacggtctgaccggcttcagctccatccgctggtactacggtatcctcgtcaagcgtcctgagcgtatcgctctgatcaagaccgtggccccgatctaatcgaccacaccactgaccgagggggagtgttccccctctggttccaacactccttaccggaactgaaaccatgagcgtagttaccaaccctctcgacaataacgaagacgacctgaagatgccttccgaactggaagtgctgaaggaacgtgccaagctgctgggcatcacccacagcaacaacatcaccgtcgaaacccttcgcaagaagatcgaagaaaaactggccggtgagccggaacagcctgctactccagtggctcccctgaccgcacctgtcagcgaagaagctgctgccgagatggcagccaatgcttccgaggccttggcccaagccgaagcaccggctccgaccaagacccccaccctgcgtaattacctgctggccgaggccaccaagctgatccgtatccgcatcaactgcatggatccgaagaagcaagacctgcccggtgaattcttcaccgtagccaacgaacacatcggcaccgtgcgtaagtacgtgccttttggcgagcagaccgatggtggctaccatgtcccggcctgcattctggacatgctgcgtacccgtgagttcctgtcgatcaccaccaccactcacccggtgaccaaggcgatcactaccaagactcgctacgtcaaggagttcgccatcgaggttctgcctccactgaccccggctgaactcaagcagctggctgctgaccaatcggcctcgggccgtttggaagaccgcgactaaaacttagctcgcatacggaaggcccggctatggtttaatagtcgggcctttttcatttgaaccaagaggaaaccctatgagctgcggagctgataacgttgccaatggcctgatcacctctctgcttgcgggtgagtcgttcgacatcccgactgtggacttcaccaagccggagttccagttcccgtatgacccggacagcccactctacatgcagatcactccggtcacgctgtcggacctgactacccgtacaccgggtggggatggtgcgttcgatgcactgatggatgctttccgtctccacctccgtgaggaaatggagaagggccgtatcactggtgccgagtacaccaaggcgtacactgccctcgctgacgctgccatgaaccaagcggctgcattcttgctcggcaaggatcagtccttctggcaggcacagtcggcacagattcaggcaatgactgctcgaatcgacatggagactgccaaggtacgactggcatccatgcagctggaggcccagaccaacaaggcccagttcgcctcgaccaagatggacttggccaccaaggacgttgagtactgcattgcccagtacaacctgtctgccatcatgccagcccaactggtcactgctgagctgcaacaagctggtgctcgcattgccaacgacactgccacctacaacttgaacaccatgatgccgttgaaccgggacatgctgaccaagcaggtggatggtcagaacatccagaacaacacggcttccttcaatctgtcggacatgatcccgcagcaactgaagaaccttcaggctcaggagcgtctgctcaaggagcagatggaagcccagcgtggccagacctcggatgtccgtaccgacaacttcccgattgccggtgtccaaggcaagcagaaagagttgtatgcacagcaggtcatcagctaccagcgtgatgctgaagtgaaggctgccaagatcttctcggatgcttggatcactcagaagaccatcgacgagggtctgctggctccgactgcgtttgccaacgcttcggtcaacgaagtgctctacaacatcaaatcgaagaacggcctggggacggtctaatgggctggtttagcaagaagaaaaagatctacgtctcttccgtcacctacaaccttgcaggtgatgagaaggatcatgttcgttatgtgccaactacggtgctctccaagatcatctcgaacagccagttcgatatgggtgagacgctccgtggttccttgattcgtgggccgggtatgcgtatgcgtacctttggcaaatgggctcgggatactggctattcttctgctatcagccttcagactggccgtcttcgtggttccgctgctatcgatacgggtgtgctcgctagcaccattgagcacgcccctgatcaagaggtgctggtggattatgccgaggtggccatggctgactacagctattgggctgagcaatggatggctgagaaccacccggcagaaatgatggaggacttcgaactggatttcaaagaagacatcaacaccatctttatcaccttccctgatgggcgaggctacggcttccagcctgtgaactttgatccgttgtcccagtacctgtttgcggcctacaccctagtgtccaccccagagccgtccgaccctgagtgggaggcacctgttgtggtcgctggttccggtgacttccctccaaccatgggctggacggtggagagcaacacctccactactggtgtcatgaacgtgaacaccaccgtcactgctgtctctactttcagtgatggccgtcctgctcagacggtgaccacggttacgccgggcactgccgggtacacgaaccaagaggtcacctactcgcaggagtactacgacggttcaggtactgagggcgaggatgagttggtcaatatcaagacccttcagcagaacatgcggaatgctgtggttgtttcgtcgtcctcgtctgacacctccactgaaaccattggaggtggtgtaatcaagaccacggttacgactacgactgttgagacgctggccgatgagttcagctaccgggaaggtactcagcgtgtggtaactaaacgctggtctgcccgtaagaccttgatctacaagtacaacactggccgtcctgagtacgacgccatgtttggtgccaccagagacactggtgtgtatttcccctttctgcccattcgtcagaacgagcagatgatcagtcctacctactatgactctatctacgacctgaacctcaaggcttacccaaaggcttttggtaggaatgccaagtacacagaactcattgacaatttgaacagtaacagctcgattggtgacgtagaccacgggttcgttatcttcggtgtggccgtcaacaccaaaaacacttcggcactgaaatacatctacaagtactttcaggccctactggctcagggaggaggaggtactggctacgacgcatggaaggctctatggaacttggccgatatccgggccagggcttgggtgagttggcgtgaagcccagtcggatccaaacagtcctctgtttggagctgatgagccaccaaagggtgtttacccagcagccccgatcacctcggtccaagtctactcggatgtcttcaactacaacatgatcgtctcgtggagttcgatgaccgaggtgaccggggttggattgggtaggcccggtgccaaggtgggggatgtctggtggaccattggtgccagtgagactttcaacgagatcgtttactccggtggggtagctggtgtggccccatcctcctacagcaccgtgctgctcacttggcaggatggggtgaacacattccgtactatccgcaccactggtctgcaccataccaacatcgtctacaagggtaagggagtggaccacagtatcagtgcgtccattcaggaaggtgacgtaaccggcttcgtgatccctctgcatgaaggtgtctttcgtgccatgtcccttgtggaccagacggagatgagccagtccaatgcctacttggttctcaacagctacgaggttgtgaagcagaagtggtatcagactggcttgttcaaagtgatccttgtgatcatcatcattgtcatcagcatctttacctacggtgcaggtgctggggtcggtgcaggtctgctgggtacagcagcatccgtaggtgctgcccttggattcaccgggatgatggccattatcgttggttctattgccaacgctttggctgcaatgattttgtcccagatcatcatgatgggtgccaccgccctgttcggtgacaagatcggtgccatcatcggtacgattgcctctattgtggcagtctcctacgggactagcatggcctctgggcaaggcactgctggggcactcaacaacctgatgtccgctgagaatgttctgaagctcacagtcgctgccggtgaaggcattgcgtcgttcatcaacgacgacactgctgacatcatgaagcagacccaagaggtgatcgacgactacaaccgggagatgggctacatcaacgatgagtggtacaagaacctcggctacgggaacatcctgttcgacccaatgcagctgactgacattggcaagcaggacttctaccccgaaagccgggacatgttcctgagccgcacattgctcactggttccgagatcgctgagattacgaactctctcctgtccaactacaccagtgttagtattagcactgaactaccaatgtaacggaggcctcatggctaatgtccaacaacaaagccagttcggtgtgcttgaccaactgggtgcaatgctcggcttgggggatgatggcattcgggaaactatgaccattcccactgccctgaacaccagcagtaactggtcccctccgggctcgatctctaccccggtcaccactgctggagcaggtggtggtctgggcaccggccttggcttcaacgtcggcacgggccaactggcactcggcgggctgtctgctctggctggtatctggggtgctatgcagtccaacaagctggcgaaggaacagttcaatttccagaaggagttcgccaataccaacttgaacaaccagatcaagtcgtacaacacggctctggaagatcggctgaatgctcgtggtgtgatggagggtcgtgaccctgcctatactgctgctgaaatcgaccgtcgtcgcctgagccggtaaggagaacccaccatggctgcattgacttggcgagacgttgctgttcctagctttgctggggtcaacgaatcgtatcgtactgctggtgctcagatgcaacaggcccttgcgggtctggctgacgggctcaagcagttccaagcccagcgtcaagctggtatcgacgctggcatcctcggtcgggccatgcagatccaagaccctgcacagatgcgagaggctttggcttctggctccctgttgcagggtgtggacctgtccaaggtcaatccgaagattctggctcagttggatgagcgtaccggtgccctgctccgtaacgctgccactgaacagaacatcgccagctccaaactgggtgacaagcgtacccaacagaccatcgaccagtctgactacacgcacaatcgaaccgtgcaggagaacgccaacgaggatgctgctcgtggtcaactggctcagcagttgggtttgactggcccattggcaaatctgtccaccaaggatcagcagaatgttgcttcgacccaatcgactctggctacccagcgtctgggccgggctgctactgcactgggcatggaccagacccgacagaacatgagccagtcggccaccaacttcaacaacgctcagatcgaccggaatgagcaacgtgaggcactgaccacggctgacaacatcacccgacagtcggctagtgtggaagacgctcgtgcgaatctagatgacatgactgatcagtccccagtggttcgtgctcgtgtgaatgccctgctgaccaataccttcggcaacctgtatgcacctattgacggtgcaactactggtggcaaagctggtgttggttcgggtgccccatctgatgggactgctaccccttcggctcaagctgctgaagctctggccttgaatgctcgccgtgtggcacagaacagttctccgggtgtagtggctgacatcgagcggaccatcggtgatacccgtagtgttggagaggtcgcccaagagattgccaagctgatccctgaagctgatattggcaagatcattggccgactggccaaagccaagtcggacaaccccgacctgtctgctgctgaggtgggtgctgcaatgacccgctctctgcgtgatgcaggcttcttcactccggggaccacttcgctgggtgagggtgcaggctacgacgacggggcgttcactgccaacctgaaggatcttcgtagtggtaaggctgactaccaatcggctggtaatcgccaggtgcgtgcagtgggcactgcgatcaagaatgctgacgctgccttgaccaaagccaagcaggaactgctacaggtccagcgtcgtgcccaaacccagtcgggtgtagacaccagtcgctatcaagagcgtgtggatcgtgcccaacagaagctgaacgatgccatcgagaagcagacgagcaacccggacttcatgcctaacgtgctggaagtggttccggtgccagtgcctcgacaggctgttcatcctttcccactcgggtaacataagaagccccagcagaaatgctggggctttttgattttacatggtaaagtcttcctcaaacttatccttagataggaccgttcatggctaacccactcgacctgcttgcacaagcagctcaaggcgtccagatgatgccggaagagcctcagttcccgaatctccgcaatgacatccccggtgacttcagtcaaccggctactattgctcgggccaatacccctgcacctgtccatgacgagcttgttcctcagcaacaggcacaggcagtcaattgggcagccgaggctgcacaaaggactcctgttcggagcaagatgatctctctggatcgtatcagccagtccaagcaatcgtccgttgctcaggcagctgctgccaagcaatcgttcatggctccacaggattactttctgaacgctgtaggtgcagacactgacaaaggccgtgacactgccactgaggtagaacgtgacctgcgtgacctgaaccctctccagatcctccagaagtatggtgacgaagaaggttcccggttgatcgccggtcaagctcgtggctatggccagttgacccaagcggacactgcccttgcccgtaacaagaccgagctacaggatgacctgattatcaacttcggccaaggtgttggtggtgctctgggtgggttgggtgctttcggtctgggcctcatcagcgatactgctggtacttacgctgccgagaaagttggtcagttcaacaagttcatggaagggatccagtcgcctcgccttcaagcacgtcaaggtgtgaagcaagccaaagacgcactggatagccgcgactctgctgcccaagccgtcaaggatgctgctgagtatggtgatgctgttgctggcctgaagcgtattggtcgtgacgttctgtcgtccctgtccaacgcaactgacgaccctgccactctgggtgctggtatcacccaggcagctggctcgttcgtggctgctggtcctgtggctaaaggcctgtctgccctatcggggggtgcgctcggcaccactacggctatcgctgccactgaagctggtggtgcatacactcaatcggctgaccagatcatgagccgtacccatgagcagctgatggaaggctctcagtactaccgtaccctgatcgagcaaggcgcctcgcaggaagatgccaagcgtgctactgctaacagtgtcggtctgactgctgctgctattactgccccggttgcggctgctgccggtcgtctggtgcatcgttttgaaggcaatgtcggagcccttggttccggtcgtcagttggctgacaacgtcattcgtgaaaccgcagaagagtccatccagtccggctttagccagttcgctcagaacgtggcaacccaacagatcgcagacgacaagcaggctctgaccgaaggcgtcggccaacagatcgctgaaggtggtctgtacggcatgggtatgactgctgcactgggtgctccatccgtagctcgtgatgctgctgcggctggtggccgggctgtggcttctgccttcaatgaccgtctggctcgtatcgacgaagccaacaaagcgtcctcgcctgtgtccgacgaaactgtcgctcaggctgctgccgaggctcaagcgtctgctcctgttgctgagcaagtcctgcgtgaagccgttgcttctgctcctgctgaacagcaagaagctggcaatgcctacgtggaccagttgctggctgcatctcagttcagccctgacgaagcccctgctgctttcaacggtctgttcgatgacgtgaccactcgcaccggtgcgatccagcgtatggctgagatcgtgaactcggctgaggaaggttcgaacgaccagctgcgtgctggcttcgctctgtacgatttggtcaacgattacgctgctgccatcaaccaagatcctgacgctctgtcggctctgcctgctgataaccaagcagcacagatcgtggctcagtaccaaggcctgatgggtgctatccagaactccccgaaggttgctggtgcaatcgacaaggtgatgtccctgctcgaagcctccgaggccaagcaggttgacgtgactgctgaatcggtgaccacgcctgaaggccagcaggaagtagcggacgtgctgtccactgctgaactggcccctgagaaagttgatttgggtactgctgagaagatcctgttccagattcagcaaggcaacctgacggtcactccacgtcaaaaggctgccttggattcgtctgtggcgatcctacgtgcggtgcaggaagctgacaaagcggcgatagcagctggtcaggcggacccagtgagcctcaatatcagcacggtagacggtgagaaagggaagtcgctgacacaacatgccaagggcatcatgtcggcgtggaaggcgggtgaccgtgatctcgcagctgaccgacttgtcgatttgaagaacttcgctcaaggcatgagcaataaggtcggggctctgaatgcccactttgctgcgggcaagccgaatgctgagggactgcactacgaggtgttcgttggtggagaggctgtgccctccaaagccaaagtggctacccgtactggtagccaaggtggcatccagtttgctcagaaagtcgctcgtgaggcgaaacttctggctgatgtttacaacggtcttgcgaccgcattcccagatcttggagctgaacatttggcggtaaccccgctggcaagtgaattggtcggcaagcctgctgaggttgtagcacgtctcaaaccccaagctgccccggtcgttgaggtgaaggataccccagctccacaagctgcacccgctcctaaaaaagaatctgccccagctgcgaaacccaccgcatctgtggttgagaaaaagcaggcacctgttcaaaaagtagctgaacgtgtagtggaagaagcaccagttgtcgccgaaccggctccagcactgaagggaactgctgctgcattccctcaactgatcggtggcgagtccaactacttcaaccgctcgttcaagctgcccaaggaacagcgtactcgcaccatgggtactgaggcacccgtggccactgtccgtgctgcactcaaggactctgcttccctgactgctgccattggttccttcaagggcaaatacacccctgagatcgccaaggcctacgacagctaccttgccgtggctgaagacttcgtttccgaactggatgacactcttcagcaatatctcgattctccgtacagcaaatccaacccgaccactattcgggagatcgttgacggtgccgaggttcgcacgggccaaggtgagctgttcgagcctgctcgttctctgcaaggccgtgttctctccattgcggagcgagatggcaatgacgtggtgtacaaccccgagttggcccaatcggcagtgctcgccgggttgcagtggttcctgaccagtgacaactacgccagtgagcaagacaccacggacatcgccaagctgcttggcatggaagaggcgtctgtctccgacgagatcgtacaggccctgaaccaagggctcagtgtgaccgaggccaagcgttcgcttgccacgaagatccgccagtactggggcgtccagaacgaagccgatgccggtatcggttatcaggaaggtattccagaagcggttgcagccgaagtgctgcgtgcattcgtgaagggtggctggctgactgaagagacggtggagctgaccgaagctgatggtctgcctgctctccctgacggcaagccgaacgtgaagacctttatccagttggtcccttccgagatcccagctgactccccgctgcgtgcattcccttcggcaatcgaacaggctgtcctgatcgaaccgcaggagatgaacttcatcggtgaaggcagtctgcctccggtagctaaggatcagttgcgtaaccccggtgtgaagaacactgcccagcaactcgccatgatcgagaaagagcaggcaactccttacaacgtgaacacgcacatggctggtttctacactgcccttggccgggacaatgtgctctcgctgttcggtgctggtgaggttgatccgaagaccaccaacgtgaaccacgctcaatccatggaaggtgtgaaccgttccgtggtggctgcgttcgaccacctgcaaagcctgctggctgaggtggacaatatcggtgacctcgctaccacccctatccactaccagttcaacatgactcgggttgctcgtctccagatgctgggcaagtacaaccctcagtccaacaagctggtacgtgaggcgatcctcccaaccttcgccaccgtggacctgtccagccaaactggtcaggactacaagcggttcatgctggctgtcggccagatgctgggcgtgaaggtccacaagatgtcccagtcccgcagccgtgctgcaactgaggccatgctgactggtcctctggctccagcggttgaggctctcgccaatttctccaagggcttccgtgacagcgacgtgctggcaccttctgccacgttggacaatgccaccgtcgagatcttgaaggatgccttcaaggcctctggcgaagcactgaccccgatggcactgcatgctgtcatggactacgcccgttacctgaatgctgaggacaagtcggcgttccgtactgctgtgtacgtcgaagctgacggtgtgaccaacggcccgatcaacgcaatggtgctgttcaccactggcctgttcaaaggtaactggatcaagaacatcgccaagggtggtctgttcttcaaccgtccgggcgaaactgtgaataccaacaacgagtcgggtgattcccgtgacctgtaccaggccactactgactcgctggatggcaagctgaacaacctgcgtaaagtcctgcgtgacgatgccaagggcacccagcaaatggacgccatgctgcgtctgatggatctgttctacggcaaagacctgaccttccgtgaggaagagggacaggacgccaagctggaattggcccgtggtatcgccaagaacccgctgacgatcaccatctacggctccggtgcaggcggtatcgctgccaagatgaccaagatgctgaccgatgctatgtacgagcgcatgagccaagtggcccaagcacgtgctaatggcgagacttcgattgctctggccatgttcggccctcagtcggtgagcgtcgaggatgccaatgccaagtacgagcggtttgtggactccttcaccaagctggtgaacacccaagctggtgtgggtaaagacggttcgctgttcttcaagagcaacccttccaaggatccgaagaagtccttcgaccctgtgaagttcaccctgactgcccacgatatcggcaacatccagtccaacgtccgttatctgttcgttgacccgatgcgtgacgctattcgtgacaccgtgggtggcgagctgctggatactgccgagatgctgcgtatggcaactcaggcccagtccattgttctggagcatgccttcaaggctgaagttgacgccctgctggcacagaaggccgaagacccaagctggaagaagaccgacttcctgacccgtcgtgagctggatggcatccgcaagaagctggagcatctgagcccactggttcagaccgagcaccagaacttcttcatcgccggtagcgagactgctgacgttgaggcgtcccagttcggtcgctctctggacggtcgcttccgttccccggctttcgtggctggcccaactgacgctggcgtgtcgggcatcccgttcctgaacatcggttccggtgatggccagatgatgcaaaacatcagcgtggctcctaatgcaccgaccggcaccctcaagatcttcgacggtatgaacatgccgttggatcagatcgagtccggttccgaggtggcaaacaaggccgtgatggactcgtggatgggcaaccctctggctgccgttcacaagtcgttcagccagttcgtgtctgacgccaagctgactgacctgagcaaggaagcccgtgaggctctgtccgaagctctgtttggtctgggtgacaagtcccacaccgagaacgagatcgtggacgctatgacctcgctggtgagcaaccttgacactgctcagcagttcatcgaagcccgtcaccgggtgatgagccgtgtttctgtgtcggtagaccagatggctgctgtgggcatgccgtacacccaaaacggcgacctgccattggctggtactgatcctgactctatcgctgagcaactgaacgtctacctgatggcagagctggcttcgatgcagggtgacaagccgtcgcacaccatgtcggctgacatcgctggcgtggcacaagcacacgagactggcgtgtcgatcatgaccggtgctgacctgccccagctgaagaccatcttcactgctgagcagaaagccgtgctggatgtggttgtcgattcgctggcagctcaggactacaccattgtcttcggcaatgctcagcagatcgctgactaccaagcagaccgtggcctgccgggtgcaactgcatcgcctactggtgaagtcttcggctacaccaaccccggcgacaagacgatctacctgatcagtccaaccactgaaaccttcatgcacgagctggtacacgctgccaccttcgaggccgtgaatgctcactatgctggtgtcaccaccaagccagtggcagatgcagttggtcgtctggaaaccatgatggaagacttcctcgcctcgggtgctgagctgactcagacctcccagtcggtgaactctgccttcaacaacgtctcggctgctatccaagaccacctgtcggctggccgtcctgccgaggctctgaacgagttcatggcgtggaccctgaccaatgaatccttggttcgcgtagctcagcgtcagcaggtttccaagctggctcgtatcaagaacaaggtggtttcggccatcaagtcgctgctgggcatcaaggaatcggctggtcgtgacctgttcagcaacctgctgttcaacagctccatcatcgcccactcccagcctcagctggctgagcggtttgctgctggttccctgttcatgaacagcaactacggtgctgaccagcgtctggcagatgtgaacgacaccttcaacaaggcaatcggtcgctacctgcaagaagccccaactgcccggaacatcgaccagcagtcggccttcatgaccggcatccagaatgcctaccgtgtggctgagtcgttcatgaataacggcttcaacatgactgcccaagaggccaccacgttcaacaccatcgtcactgcactgagcactgaggccacgcttgatccgaatagcatggctgctgttcagcagctgtactcgcatgtgatgaagcaactgtcgcctgagtcgttcatgactgacccgaacagcactcagccgggcgtctatgagactgcggccaagaagttcgatgtgctgtccggcaaattccttgtcacccgtgacctcgctggccgttccagcctgctgccagctttcttggcactggccactaccaacaacgagttccgctcggtgctggagaaactggaactgccgaagactgctgccaacaaggcgggcactctggacgctctgctggagaacatgggcaacagcatgatggaccgtctgggccagcgtatgactggaaccaacaaggccaagaatgttcaggaggccattgacctgctgaacgctcacatggccaaggtcatcaacgaccgtgagacgctgatcgaccagtccttctccaaggctggtggcgtcatcgaccgtgcaaatgatctggtaaccagtggtatggagcgtctggctgggcaagctatgaagttcgccaagcgtactcaacgcaatgcagctggccgtctggaacgtactgccggtggcatcgtggctggctttgctgccctgatcgacgagcaaactgccaagggcgtttctcagtccactatggctgccatcaacaagaccaagctgtgggattcggttcacaccctgatcaacgatgtggtcggtcgcaccgacagcaatgcttcggtttacgacatgatcaaagcagttcgctccgtggttcagcgtactcgccagcaataccgggagaacctgcctgagctgctggcttcgaagttcagccgtgagctgaccaaagaagaaaaggccagcctgcaccgttcgatggcgaagactgaccttgctgctctgggcaaagacgcactgcaactggctgtcaacccggaagctgctatcccagctctggaacagggtctgtctgccaagcacattgagaaggccaagcaactggccaactacatgctgactggtgtaccgggcaagaacctgctccgtaacccggaagctgtggcccgtctgctgggcgaaggtcagaaagtctcggctctgcctgacgtaggcaagttggaccggctgatcactctgtacgccctgcgtggtctggaccaagcggacaaggatatccttgcttccttggctcaagatgaagccactggcatgcagttctcgctggactacctgactggccaacgtgctgaggaaaaacggaaggccactggccgtgccaagttcaactacttcaagggctacgtgcctgagatccgtaacgaaggcgtgtccatgctggttgcccacgacagtgagcacgccaagttgctggccaagtcgtacacccgtgtgggtgactacaacggttcgcctctggaacgtggactgaagcgcagctacttcttcatcccggtttctgcccgtgcccctttcgagcaaggcatcatgcagaacgttcagcagaccgctggcggtgtggatgcctctaccggcttcaccctggcccagactgctggccgtatcaccgatgctgctgacgtgaagcaactggctcgccgcatgcctcgtgatggtggccgtgaggctctgctgccggtctacaacgaagctggtgacgtggttgccttcgagcgtgctttggacagtgacgtgatgtcccgactgctggctgaccaagaccttcacaagtccatcggccaatggcgtggtcgccaagttgaggaaggctacagccaagtcttcaacgaggctctgatcggtcgcctcaaggacatgtacgaccgggatctggctgaaaacccagacaatgcccgtcagtacgtggacctgctgagcaccactgatccagtgtggaaggatgctgttagcttgatgaaccatgagactcgtgctctggtcgagggtgccttcggtgacaagttcatggtacgccgtgacatgatcaccgatgctgtcggctaccgtgctgcctcggttggcgatgtttggactggtaacacccgctggagcgagggcacccgtaaggctgttcgcaacgtcgccactgctgtattcggcaacgacgcctacaaagccctgctgactgccgagaaaaccattcagtcggttgtggcagatgccaagaccttgatcgtggtcaagtcggtcatcgttccgatgagcaacctgatgtccaacgtctaccagctgattgcccgtggtgtgccaatccgtaacacgctgaaggcattcccggctaaggctgctgaagttgaggcctacaccaagtcgctggtccgtcgcatcgaagcagaagccgagttgcgtgcggctggtggtgatcctcgtgttgagcgtcggctgaaaaccgagatccaagcgatcaacgacagccaccgtcgcatgagcatctggcctctgatcgaagccggtgagttcagcggtattgctgatgccgggatcacccgtggtgagatcccactgacctcgggtcgcctgcaagcctacatggaacaggccgcatcgaagctgccgggctggggctcgaccattggccgttacgctctggtcaccaaggatactgctctgttccaaggcctccagaaggcagtggaatacggcgacttcttggccaaggctgcctactacgacgacctgacccaacggaaaggcctgactcagaaggaagctctggctctggtgactgaagagttcgtgaactacgaccgactggctggccgcttccgtggcaccatggaaaacctcggtctgctgtggttctacaacttcaagatccggtcggtgaaagtagctgcgtcgatgatccgcaacaacccagtgcatgcactgctggcaggcatggccccggcaccggagttcttcggtactgtcggtctgccgattgaggacaacatgatcaccaagatgtttgacggcactctcgactactcgatgggaccgggccaaggtctgcggtcgatgatgttgaacccttggatcaatctgacgcagtaaaaggtgttgacggacgccaaggttatctctaatcttggctccgttgttgggggttcgccaagttggttaaggcacgggattttgattcctgcacgcgaaggttcgaatccttcaccccctgccactttttggtgagtagcaaagtggtaatgcaccggactgttaatccggggatcataggttcgaatcctatctcaccagccacggtgtcttagctcagatggttagagcgctcccttgtcacgggagaggtcacgggttcgaaacccgtagataccgccactttttcgggtgtgtatgcaagcggtcgaagcaaaccggctgtaacccggcacattgatacaccttaggttcgaatcctaacgcacccaccaaataaaaaagcccccttcttcaagggggctttttcttgtccgacgggtagtcgatcagccagagaaagccaagaaccaagcaggccactatcgcaattgcgattggtagggcggcagcgtggatggcactggcaacacaagccaccagcaccaacaggccgagccctactaagagggctcggaacatggcttagttctgctggttgttcggcttgcggaggttggcgaacagcgactgggtacgcggacgctcttcagcggcaggctcatccttgaccacttccggctccggctcttcagccggttgctcttctacagccacgggagactcagcgggttggggatccaccggagtttcaggctcttcagcctgttcaactacgccaccagcagccgaactcgatgcagcttccgaaggttgagcatcgggagcagagttggtctgggtggaggcctgctgttggtttcccacagcagcgtcctcgaccaccggtttggtttcaaccggagccgattcggctttctggcgacgctggcgaggcttacgttgcggcttgccagccgggtccggagcatcaacaatgcccacgccttcgttcacgaagacagcaatggtgccgtcctcttggaactcgacgtggaagttgttggagtcgtccagacccagctgggcttgaacatagcccagtaccacgtcggagacttcagattggttcagggtgatttgcattacgaagttaccttcttccacagggtcatgagttgctggaactcgggggtgagtactccagcatggattgcaccgatggcatcagcccggtgctcgcagttgttcgtgggcttgcctcgatgccacgtccacccggcatccgggtagaggtccatcgcagcagcgatcatgtcagccttgctggcattcgggttaccggccagggcctttttaacagccttggcttgcacctcgatgacgatgatccccttggctcgcatggcaccgacgataccgtgggcaacacccacagacttcatcgcattggccgactgggaaccaacaggacactcggagaacacgaccttcacacgctccccaacaaggaaagcgtgtgaggccagctcttcagtccggcgtagatcgtccgagttggttcggacttgtttgtccttccccttctcggtcgattgcagctcagtcttcacgtcggtgagtattccggtgttcaggcaaagctggccttcagcggtcccccagttcgtgaaactggggtccattccggcaaccgggatgatcacttacttactgaacagcgacttgcggccaccagccggggcagcaccaccagtaggcggtttgccagcaggctttccggcacccggagcagcacctttacgcttgtcgtaaggcttgtccttgttacgttccagccagctgtcccagaaggacgattcctgaccggcacgagcctcggccatggtgaccttcgactcagtgtggaagaccttggcgatctggttcagctcgcgggtttcgccagtcggctcgtactcgccggtctggtcgttcttcttggtcttgtcttccagcacgtgctggatgcccagcgacacttccttgtcgcagagatcgacggcgaccatgaccttggtcgggacttccttcttctggtcgtagtcgtagatcttcagggtcttctcttcgaagacctgttcggccagcgggaagccggtggcagcgaggcagatgtcgtcgatggtggtgaagcccggcagcggaaccttcttggactggtcgtccttgttcaggaagaagttttcacccttcttgttggtgatgtagatggtttcacggtactccttgccatccggcaggatcgccacgacggtgcagtttttcgcaccggattcagcctgaccggcgtacagcaccttgaccttgacgttgtagatgtcagtggccaggggcttgaagccaccgcccagacgatcttcggattcttcgaggccggtggtagtcaggttgccaaacagattgctcatgattttttctctcttgattcagttcagggtttgggcacaccacaacggggactagtcgttgtagaacttgtgcaggtggtccagcaagagctggcagtcgttgtccatgaaggtttgcgaacgactgaacatccccatcggtgaacggatacgctccccggtggtggtcttggtgggccgggtttggaacacgtgcttgtaaccaagctcttcgtcttcctcggtgatggtcaatagatcgctctggtatgcttccagagttttcagatccaccttttttgctgccaccacggtggagaagtaggcttccacaccattgcctttcagggcacctttgatcgggaccgaggtcttgatctccattgccttttcgttcagctcgtccttcacgtgggccgtgaagataacgggcttaccgaagctcgccaccttgctttgcatggtggtcttgaagaactgctggtagttagaccagcctttcatggtgtcgtgagcaccgagcacgtacagcgattcgaacatgtccatcaggaacgtcagcgagtcgccgatgatgcccttgatgtcacgttctggcaggatcgggttgccttcttcgtccagcagagtgccggtcgcatagtcgaacgcatcatgcacctgatacggatcggtgatgatgtgacggtcgaacttgttcttgaagggcagacgcttgcctgcttccgtgccgaggtacagccaatcctcttggtcacggatgttgcggagactggccgacttgccggtggcggattcgcccacgacaaggatcagctgatcgttcatttgctcttcggacatgtgtcctcctgagtgcctgacagccatgaaagactgtcaggcggttgcgggttacttccgagagaagcgtttgccgacagtcaccatgatggtgctgtcgatttcttcctcgtccatcgggttgttcagcttctggttgaaagcgtgaacctgacggcccacttccagaagggacatgccgttgtccaccagagccaaggcgaacttgatcatctggttgttgcgattgccgttggcgatacgacctgcaaaccagcgttccagattgtcgagagattcgactttctggtactgctgctggtacttgtcgttcatggaagtgcgtgggatgaactgaagcacgtccagcaggacaggctctggcttcccttcttcggtggcaaactcgttccggtagaacgtcccgccactgtaggtttcccacttcttctcggcttggttggccgattcgtccgtagcgaacggcagccagttcatcaccgagttcatgaactccttgtagtcgtcatggtcgaggtacaacttgaagttcatcggcaggatcagacggaaacggtcttcacctacgatgtcctcgccctcgctgtccacaccttccacctgacgatgacgtttggtggtgtaggtcatgaacttgtactcagccatcagctcatgcacagcagccagactgacaccaccatccacgtcgatgatgatggtgttgaacccttggatcacgttttcacgtgcccggtggccggacttgaagtggtggttggcccagtgcatgggcgagccgtcttcttgctctgcttgggtcagcaattccagctggctgaagggcacctcttcgttgctgtagccgtaggcccagtgcgtgccataggacacgatcagctcgtcgaggttggtttcctgcaacttctcaccacggaagaactcgatgccatcgacgaatttcttcttgatgatgatgttccggctgtagccagcggccacggccatcgtcatcagctcgttccgtgctgcgttgctctgcttgtagaacggcagggcctcgtgcaggtcagcgtgagtcaggtcagtgcctacgtcggcgatgtaacgagccaacttcacataggccttctcacgggtcaggatgcgtttgaacgctgcacccgactcttccaccagcagaatggactgcttcagatggtccatctcgatgttcaaggaaccgtcgatgaaggccaacgcaccagcgagcttcagagccttgaagtagcgatgctccatctcggccttacgcatttcctcgtggtcggccatgctctcggcagccttcttgcactcgatctggtaggtcaacagggcaatgcccacgtcgtcctccaccttcattttccagccgaatacggcaggatcagccaagctgtggaaaatgtccgaccacttatccaccgtggcggagttcgtggggttgatcaacccggcgtaaatctcagccggggtcaggtgcaggtgagccttcttctcggcctcaccccatgcgaacaggcaacgacgtgcgtagccagtgtccagcaaggagtagaagtcgtcttcggtcggcccaccatcgaacagcttggacggagtaccgaacagcagcaagttagccggggttttcccgtcaatctcttcgcctcgttggttctctgccgtgttcttggtgagcttaggcttcaccagaccttggtcaaacaactccagatacagagccaatggctccaaactggcatgaaggttggtgccgatctcgtccacctgcaagttcaaggaaccgcagttggacatgaccagcttgttacgcagctgcttgatcgccgggccggtggccgagtcgaaggtgaacggcaaaccgcctgcacgcttccactcggcttcggctttctcgaactcttcctgctggtcagtaccgttgcggactgcccggtcattggcgatatcccacaggtgcttctcggagacaactgggaaggtgtcttccatgaaacgcttgcggaaaccggcaaggaactggttttccacgatgttgacggagtgacccttgccgtagccagaggtggccagagcaagtgcataaaggttgaccgggatctcgccacggtctttggtgacgatagtcgctcgcatgcacgaagcgatcttggcgaggaagtacgccacttccactcggaagaagatgcggtcggtgttctgtgttttcgagcacaggacatcgacgatctcttcaattgcggggtggtgcgtcaccccggtcaggtcgatcatgtgttacctcggtgatcagatggattggtatttcgggaaggtgtccttctggctgcatgcgtcgaaagcatcgcagtagtcgcagcgctttggctcgcccttcacggtgatgatggtgcccttgttacctttgctggccatgtactggcgggcttcatccatggagtcgcagttcttcgtcgcccggccacctttcatggcggtttcggggttcgaatagtacttgtagaccggatccgtcatccacagctcttcgtcagtgcagtgagggatctccttttcagggacacgcatatagcgttcgatctgctccagcttgttcaccacccacttttcagtgtcggtgatgtccaacagagggatatccttgaactccagacgctgctgggggtacttcggattggtacgggcttggaacttctgccagtcggtgaagatgtagttgatacggatgaagtcctcgtggatcttctccgggttgagccagcgatacagggaaccctgcaactggtgctcatcatcccggccaccgtacaaccacgtgtaggccgtggtggtcttggtgtcctgcacgatgccatcagtcaccatgtcgaacttgccaccaacagtccattcaccacgggttgtcttcactttcttgaaggcccgctgctccacgtaaaccaatatcgggtcgccgagcttttgctctttgaagctccgaatggtcgcctcgtccgggttgaccagtacacgtgcaatcacgtgatccggggtgcccagcttggcgaggttacgcttgtagttctggacccaagccttttccacggagtcgtggatggagtggcccaacgcacgctgcaccatgtcagcaacgtcgggggcttgtcgctctgcttccggtatacgccggggcagaacgatttgacgcaacggcttcatcaggctggtggccgagatgtaattcggcttggactggtagtcgtagtcgtcattgacggcccagacagccagagccagcgagatgccagtcttgttcgtgatcatcaggtttccccttggttcaggctacagggcggtacagggcgatagccgatgcctcgctggagaacggccagtaccagctgtccacatcttgggcaggattgatggtgccgtctttcaacatgacttcgaccatggcacctttcggcaaccaagctggacgtttgccagtgttgtccatccagccgtcttcatcggctggtgggatcgaatgaacgaacacaccggcccatgcacggggctcaccggcacgcttacggtacaggccccagtccaccatatcggcattttgtggtcccatcaggtcgccattgacacgacgcatggtcacgatggacttgggatgcaagccttcgggcatggtgccgatgtcggcgttgtaggcgtaccacgtgtcatattcacactcgctgccttccattaccggcaaaggctggtgttcagcaggctcaaccggcacttgctcttcgctggtgccggacatcagggcgatgtaacggttgagggtgtcccgtgcctcgatcacgtccttgagcatggtcttacccccggagcgtactccggggatcagcagcttcttccgagcgtggatgatggtcccggtgggatcatccaccgggaacatggcgttgatgacgtaggtatcaacctcgtcaggtttgacgccgggaggcagggccttgtagtacttggggtacttcttggccaaggattccatttagctcaccttggcaggcgagtggtcttcctcgacggcaggttcgccatcggagacgatagacgggccgaagaactcttcgtcggtttgcaggccgaggcccgacacggcgatgatggtcacttgaaccggctggatttgcaggccttggttcgccgcaccatcggatgcgacttgcatcaggccacgggtggcgttggacaggtcagcaccagacactgccggggcaatggtcttgatggtgcattgcagggtcgaggcctgaacctcttcaggtttgccgaccgggtggaacatgacttcaccggacacgtgccagaagaagtatgcagggccttgcggtttcgcttgagacataacgctctccaatgaaaagaggggtgaggggatccccaccccatggaacaactacggggtaacttcagtgaccccactcacgcattcgaagacgagcttcggcacacgggcgttttcgccagatggcgaggtcaacagcacgtccacttccagcaggccaactggccagctgtcagtgttgctggaagacaccgtgatctttcgagcaaggttcttgtccacccacttgcactccagctcatgcacgagcccgtcaggctgccgattggcatgcacacggacctgtgacagtgggagccagtccgccaacgaaccgtcaacgtactgtggggggatgtcgaaggtgtgggagaacgagcccccacggatgaagcgagtagggcggctcatgctgcctccaattcgtcgatatgggcctgaagtttctcacggatcacctcttcggttgcaccgttggggatcaccatttcttcagcccacgaaggatagaacagagacagttcgccacctaggcctacttccgggtggtagatgtctgggtggtcgttccagttcacggcatcgaccaagtgcttgttcatgaacagcacgcaggccatgtcgtcgcgtaccaatgcatacccggcgtcgtggatctgggcacaaggccggatggccttccgcataaccgggtccggtcgaacatggacacccatgaactcagaccaagcccggctgttgagcaaacaccagccctggcccagtgcgttaccagcagttcggccttcggcttctgcctcatgcggagtcctgctgtttccacgcaccacttggtgaagcagtggggtacggacacgcagtccgaaggccgttgtcacgtagccacagcgggacgcttcgtccagcttatcggccacccacttgtcactcacgacgtacagctcgtggtaacgcttttcaaccgacttggccttggcctcatcgaaaccgcagttcgtcatcaaggtgatgtacgttccttggtacgtcagggcgaaggtcgggttcttcgattctgcccggagcggcttgtacttcttggcgatactattgatggactcaacggagttcgggtcgataccctccatctgatcgccaaagtaggcataagcacgcaggcagtgaccgtcgaagccatcggtgtagaccttgagcttgttcgggtctttcgtcgtgagagccgagatccggtcttccagcgacgagaagtccaaccccatgaacaaccatccggggggagcttggaagcaagacttgatgtacttgccgtaacggcccttggccgtggcctcgccctctgcccctgctggcaggttctgaaggtttggtttggagctgctcaggcggcccgagacggtgccaccgaggttgaagttgccgaacaggtagtgccaaccatcgagtcccggcacagcccctttcagagccttgatgaacgtgccgatgatcttgtccacgtccttgaagtccttgagggccttcaggaggtttttgacctgctggttcttggtgtggttgaccaatgcatccagcgagtcgccatcggctgacggttgtttggtcttggttcgactgagtactggcagggccagttggccgaacagcagctctaccatgtcgtccggcgagttcgggttgaactcttcggcagcgtcagccatggtgacccgcttgaccttcagctcactgttgcgttttaccacccaccgctcgttcttcgcatggacgaactgttgaaccaatgggctgctctgaatccggtgcatggcgtcagcccgctccttctccagaatgccttccacttcgagcacacgcttcatgttgaccggcatgccagtcaactgcatctgcacaatgtcgatggtcgcaggcttgaagaccgaggtgtacgggtcaacctgctggtcatgcaccatctgtgggtggcgtttctcgtagacgtaccacgtggacagggcatcgacgaggttgtattggagcagcttcggcagctcgatacgtcgaatatccttgatgtcctcgcccatcgagtagttaccagcgaactcgtgtgcttgatctttcagacccagcttgttaccggcacagctgttggtcgccagataggtgatcaacttggagcagtcccagttacgaagcaggacttccagaccttccagaaggccgtcctgatcgaggatgtcggtcatgaacagctggtagatcagcacgtacacgtcgaaggcgatgttgtggtagatcgctttctgcatgaacagcctgaagaactgtttcagcattgcacggacaggctcgttgtagccttgtttgccgtacatttggacctctgtcttcccgacaatggtcttccactcttcgctgatgtagtccacggggaatgcgatcccctcgtgtttgttccatgcgaacgagatggtcccgatcccgcacttgtggtgcttgaggtcgaagccttcaatgtcgatggtcagcgggcagtccatctccagcagccgaatcagccactgctcaatgtcctctggccgagttgggtactcagcaaagtggatgatgccggagccgggggcctgatacgtcccccgagcagcagcacacaaggcgttcatggccatgtcgatcttggctttcaccttgaccgggtcgtagaacattgccttgtagttgggcacgtagatgaccttgaagtcacccatggtgcagtccatcacatagccgaggttttcttccaccttcgcagccttggtcatggccttgaagtactcggcgtcagtaatggccacgtacttgaccttgccagctttgaggtaagggatcacctcgctggtgaggtactcacgcatttctgccatcggcgtctttttcttgccaggggcatagtgcaggtcgagagccatgacggtcttggggtcaagcccgtatgggtcgatgtagtgacgcacgaagtcggctttcttgatctgtggaaccaagaagcaaacgtcgtaatgctctgcgtcttcgaacgtgaggtagttcatgtgcagccctcagtagatcatgccgcacgcccagtacacgtcgatcttgtcacgcatcaacaggtactgactgtacagccgttcgttacctttcagggtgtagccatcctcgtttgaccggggatgttccttgaggctcgtcagattaacgatggtttccggcaatgcattacgcacgtccagtaccgtctcgcaatccttggtcgccagccacagaacctgcatgatgagctgcttatcgtcttcgacgatcttgtgctcagccacaaattgggcagcctgtttggatagagtgaaggccagcgacgggactgtcttgggacgttgcttccctttcgggacatacacctccccagcatgcataaagcccggaacggtgtacttcttgatctcacggttggcctgatcgagttcgatgaccaaactgttgagtcgtctttcctctggttcaaacagcttatccacagtttgttccagaaagctgtgcaggttctggatggccattagcgaacgaggcctccgaacttgggtgccaattcgccgtagaaggcgacacgcacacgggcacgggacactgccacatacagctggcgggccacctgagacacgttgcggcaggtgctgaggttctcagcgtcgatatacacgaccgggtggctggagccttgggccttgtacacggtgcgggcgtcacgctggcgaaggtctgggaacttgcccttcaggtcaaagtacgacttccattccttcaccttgctgaagtacttgatcagctcggcgtaatgctcacggttgaccggcagcgggattctgaactggtcaccataggcgttttccaccagtgcctgccgcacttccagctttgcaccacgagccagctctaccgtatcggtatagctttccacggacaggatcctcacctcatcctcaacggagaaaccgtacttgccaaagcgaggggcattgttggagatgagggtttcaccgggctggaactcgtatggcaggccacgcaggtcacggatgtaaccgttgtagtccacaacacggttgttggtgtaggccagaatcacgttctcgtggttcgggtcagccagatgggtgtcgatttcgttctggaactcttcacccgacagccagtcgatgatgcccggaatgatctgaatcggggtgaagtcgtggacgtacacctgctcgttcttgtcgttccagtcgagacgaccggactgcaccacttcacgcatctgctggttgagggcttgcagctctgggatggtggtccgcattggctccagcagctcgaacatgttcatcttgtgccggtacaccgggctcagctgctccttcacaggggccagctggtctttgtcgccgacgtagacgatcttgcagccttcagtgcctgcctgaatttcgtcatacagggcactatcgatcatggacgactcatcaatgaagatgatcttgcccatgtgcttgtaccagttcttggtacgggtgatggtggtcgagccatcggtgtagttttcggtcaccttcaagttgaagaaggtgtgaaccgtttcagcaggccgtccggtctgcttgcccagcacctcggcagccttgttggtggtcgccgtcatggccacgctgtggaacaggggctcgatgcctaccaacttgcaggcgtcgaaatacatcgggaggatctcgtcgatgaggtggcccatcaggaaggtcttaccgaccccaccggggccactgatacggacctctttgtccggccccatgaggaactcgaagaagccgtccgaggccagcttctgtccttcattgaggggcagctttttcacgtcttgcaacatggggtggatctcctactacgaaaaagcccggctcaatggccgggctccttgggtggttaactcagaccggcacgaagcggacgagtacggccttgctgtagagcgggcctttgatgactttaccgttggagtcgtgcaacgggttgccttcagcgtcgaacttgctgaagttggagcggttgacttcggtcatcgcccccaagaaatcgtaaccacgggtgtaggcgaccccggtgccggtgaccacttggtcgcacaggctgtcgaggaacaggacttcgcttttgacggtgaccagctcttcggtggaacaggccttcagatgctcagccagtacgtggatggcagcataggcgtcggtgatcagacggtcggtcaccagatcggtgccttccaattgctccagcgattcggccacttcctcgtagtggcagcccagctgggagttctggtctttcagggacggctgtgggcgagccagttggaaccacagatgagtacgcgacaatgcacagttgttgttcatgggtttccttggttcaggtaggcctgattgatcaggcgatatacgaaggtcttaacggaaatgccctgtcgggcgagttcatccgctagccattcctgttgagtcgcatcgagacgcagaaacacgtcctccatgaaggtacgacgggtatcggcaggctccacccccaagcgtttgagacgcaaggtgacggtagtcgggtggcagccaatgcacttggcgacggtggccagagacaggccaacgctattcaggcgaagtacatcagcatcagaggctttacggttgacacgaagaacggacgacatagggggatgatctccataaaaagatacctctagtctattacgactagaggcatcttgatacagcgattacagcttggcccgctcggtgatcttcttgatgaacttggcgtcagtcacgccgaggacatcccaacccttcttcgctttctgcttgaaggcgacgatctccttcgcgttctgcttgtccgggttgcggttatacaggtccacaaggtgggccatttgctcttgctgggtcatcttggtcttcttcccttcgggcagaggcgaccccttcggagcgaaggtgtcacgagtggtggttggttttgccttcacaggcttgtcgatctgctgcttggacggggccttggccttgccagtggaagcaggcttgcttgccttcttcacagcggatggcttggccggggccggttctactggtgaacccaccagctcctgggcagccatgtagacactgatgccgaccttcagagcggtccacgacttcttggactgcttcttgaacgccagcaaggccttggccgcttcgaccttggcagcagtggtgttggcctcttcgaaggctttgaccagtttctgtgctggagtcagctgcttctcagcagctttggccggggcaggaaccggagcagctttgcctactggctcaccagcgacttgcatctgggcaggcggagcgtggaacttttgctcttcctgtgcaggtgtagcctgcgacagggccaatgcacgggcatcaaccttggcagctgagcagttttcagtgtccaaatgatccagcgagttggacttcaggctggagtccaatggtgctggctctgcggtcacttcaccagcaggggtgattttcaggccaccgcccttggcaccggtgatctccacgtactccaaaattggagtgtggttaccagcgacggcattgcccagaaggatctggtcttccatcggctgatcacgttttacgcgatcacgatcaccgtccgacaaacgggcgatgatgtggtagcccttggcccggagcttacgagcgtcgtactgaggtacggcgatcacgtcctccggggccagcttggccaacacgcacacgtcaccactgaagctacgcaggtagtcccggcgagccacgtgcaaaccgttggagcagtcctgtctgcggttcgggtccaccatgtgctcggccatgtggacaaacgagcctacacgctgcttcacgttgccggagtggcagtccacgaagacaccttcttcactggtggacttcagcaacttgtagaccagcacactgccgtcgtcagccagcggcagttcacccttctggatgaacttgagcaggtcttcgacggagtggccgcgtttgatggaaccggcacgacgcaggaagttggccatggcatcaccggagctgacgcccgacgatacagccatagtctgctgagccaaggcctcacagccggggatgatggtgttgtcgtccagcacggcgatgacggtggtttcttcctcgccttgggcatcttcgttggagaagccgggggtactggccggaacagcattggccatgatctcagccacagcggctgcgttcttggtcagtggacgctgttcttctggagtcagctcgacaacagcgtcttgctccagctcttcggcctcgggagctggggccgtagctggttgttccgctggttcctcggccttgtccgtagtgcccatgacgacaggcatgatgggttctgcgaatttctccagcagctccttcgccttggtcctgaccatcttgaagaaacgggcgacaccgcccatcttcttctcggtttcggcgaaggtgttcttgtcggccatgtcgtcctcggtcagcatgtagaactgcggaccttggggttcaaaagccggaaccatcttcgccacgagatccttcaggcgaagatcgccttggggaatgacgatggtttcaccgtcatccttgtacagggtgacgttgtgaacatcgacgacgcagcacacgatcttgatcgggtagttcattgttgcacttccttcagaagttgacgggtaagttcatacgggatggcgagtttctcgtcacccggagcacgtgcttgcagtgcttcgccgatacgttccagattcacgtaatgagcccatggggagtcacgcagggtacgcttcaactcggtaacttgagggtgcttctgcaccttttcagctagcaggttgcatttctccatcttcttcctgaagccgtgaaagctgctgtcttcgaagaactgcacgagagtcatcgtctcgacagagatggtgaagcggaacttgaacggcaaggaatctaccagttcttggtgcaggcacatgttacgcaggatgccatccacatcactggcatggtgatgtgctgctgccgggaagtaacgggtgaacgccaaatagcggcggaaatcaggtgcagccgacaaagtgtcgtccacatgctgagcgacgtatttactcacttcgggaatccccttttcgatgaatttatctacctgtaccgtggtgatcacagcaatttgcttgccccacaacttattgaccaattgagacatcttagggctcaggtcgctgaagcggtcgcaattctgttgggcgttgttgaggaccacataggccacagggtcgaatacgtgttggtctgggttgtccggttggacgttcaagcgagctacactcaagaggaagttgccgtcgccgttttctgctgcgtgcagcggcaggtagcctttacgcttgacggtcggcttcttcggagcacgctcttttggctcttcgccgggagcacgctcgtaagtggcacgggccgggatgtacgtgtgaacgtcataacccagcttttcgaacacggccttgatggcgtcatagtgcttctcatgagagggcaactgatagacgacccagccggtacggcgcttgtcccctttgttgtggagctgctgctccatgaactgcttgatggcagtttgggagcgagccaacaggacacgcttgaatgcataaccgaacagcttgtgtggtgtatccgggttttgacgccacgggttgatgaactggatgctggtgctatgttcgtagggctcgtagacatacgacaaacgctcgatgtccatgaactcttcggccttcacagcacgtaccagcgggccagtgacccacttgtccaaagcgtacttcatcagctctggtggccgacgacccggatagctcaccttgcccttacgcatagcctcgtacagtcgagcagccttcaagaaagccttgcccatctgcttgtccatgcccggcagagtgtgaaccgcatggtggaaacgcttgatcaccatgtccggcccgttgtaggtcagcgaacggcgagacagcatctcgtggagtgctgcccgacgaagttcgtaggcccagatgccagcctcgtgttcagcgatagcacccttgaccacgggcaggttgatgtctgtcacgaggtcagtggtacgggtcaccggtggagcttcacggatgatcttgttgaccagcgtggcgtttacctgacggttcacgtgcttgctgatctctgcttggcgagggttgaacttcgccaacagttgcttgatcgtctcgacggtggtgtcggtgaagatcagagcttcccggctaggggcgatggagatggtgtcaggctcagcgaggaaaatgatgttggctgcattccacagctgttgcatgttcttcgtgacctgatcccacatttcaccgtagtgatccatccggggaaccgggtagaccacgtttccataacgcaggttgatcttctgggtcagagtgcctttgaagctgttgatgatgtagccggtgtgggtgccgtcagtaggcagcaccagcacacgctcaccattcaggtcagcatggatctggccgaggatcagtacctcgcggatcaggcgaacaaagtcagcagcatcatgcggcgacttcagggggatggtcacacggatgccagtctcttcggttggcacctgcacgatggtgtcgatggagggcttgcctcccttttccatgctcgacttgctcacacggtagaccgacttgacacccccgtggtgactgatcacttcgaagttgtcggtgtagctgaatggggccttggatccaagtccaaagcctccggtgaccgaaccgtcgtcacgcttggtcgagttaccgaacacaccataaatcgggccgatcttttcgtgagggatgcccggaccgtagtcacggatcacgatattctgctcatcgacggtgatggtcagagccttgtcggtgcatttgccgacgatgtggccgtcccagccgttgcagatgatctcccgcacggtggcgagacgagggtaggtgtagagagtggtggagaagatgtgcatcagagccgcactgtcgctcacacccatctcaacagattcttttttgccgagaacggcatgagttacagcatcagacatctggctgacttgcatttcgatactccttgaggaatgaagcggcccctgttacagggccacgaaccaagaaagcactagaacggagcttcttcgtccatcaggtcggcgaagggttctggagatgcaggcttggggatggttgggaagaagcccatgtcgaaggtcttctccgggtagtcaggtaacagacgggggtctgtcttcttactgggaaattcgcgggcacgagtttcttcatcgaaagcatgaggatcaacagcttttcttggtttccgtcggacaggcacatggcgagatcgccgacagccactgtgaaaatactcgtcaggttcttcgtcccacgctcgatgtatcaggtcatcagcaatctcacccatggtgcttactccgagatgtattcgcctgcgagcatcttgcggaattgacgccagcccggcaggttgccgtgttcttccgggtgatcccacatatcccggttctgggcagaagaccagctacgaaaatccggggttgcttggtgctcggtggggctggcatgcagaggctgtgcaccgaccagacgctcatagagagcaaggtcttctgccacagtcggaggcaggccatcgtgggtcaggtagctgacacgggcacaacgggcagccgacatagcgatcagcacgttgagaatttcagcctcggtcggcatggagcggatcagacggcccacttgcagatggtcgctggcagcacgacgatcagcagcagtgatgtatggcagatgccagtcaccgtcgtacagtgagacgggtttgctggcttccagcgcttcatgccacagatcagcaacgtgcttgatctcgggctgtgcatccttgtggcgacgcagccccatgaagttgctggtcttggccgtggtacagatgacgtgcatccactggtacggctccagaatgcggttggccacctgcttgtgcaggccatgcaggcacatgcgttgggccatatcagcagcctgacaggcagcttcttcccacatgccgatggccagcgtgcgttccaagccggtcatttcctcgttggcttgcatgccgggctggttgacaccccagtgcagaggcatcgccggatcgttgcgtacctgctcgatcattttcttgaccgggatggcacggctggaactggcgttacggctgaactcacggtgagtcatgaactcagcgtggatgaaacgggggtacttgaattgcgtggtgatcagctcttggtcctgtgggccaatggaatgagcaatgaccttgacttcgaaacccatggggctctccttcagtggatggatacctgaaaaagaaaaaccccctcatttagagggggttttccatggcccaggccggagatgtgttaggcgacagcaccggcacctacgccgattttgcccctggccacctcgctatcgttgacggcgacgttgaccagttcggataggcgataaccattgctctcagcggtcagggatccactgcacgttcgggcgaccgaatcgacgctggccatgtaggcctgctcggcatggaacttggcaccttcagcaccgtggtcggtgacgtaggcgagggcggtgatcagatcgggacgcaggtcttcggcgaagacagggccagcacacagggcgagcacgccgaggcacatgccaatcagtccgtggtacaggcgtttcatgatacgcatagcagagtttcctcttggttcaggttgggagaggtaaagttacctcgaatttacgcctttgggaagcgcatgatgtgaacttcggcacccagctcgccaccgagggcagcgatcagttcacgcagttctttgggcatctcgtcttcaccgggaatcgggtcacgagtcggagcggtggcagccggggccacgctgtctttcggcagcagatccatcagggtggccagcacggcatctttttccttggaggcattgatgccttccaaggtcttggcagcgttcgccagagtgactatggcctgtgcgttggtcacattgacctgagcacgctggcggtccagctcgacctgatcgaacaggaagtggttgtgggcctgctcaaccatctgggcttggccgatggatggctcagctgcatgtggctcgttggcctgagcggcttgacgtgcttccagctcagcacgcagttcacagaagatgcacatatttcactttctccgttggaggggggttttttgtgcttcgtccagccatttctgaaggttctcttcagtcacggtctggcctatgcactcgttgatgaggtaggaagcgaatcgctcccaattctcaagttccttgattcgctcgcattgctggatgatggtctgtcgttgggcagcgttcatctgctccaacgtgcgagatacctcggccatcagctgttacccagcagaccacgcaaggtggaacgcagggcttccagttcagcattacctttgccagcttcgaggatggcggagtcaacctccatacccagttgctcgacttcttcagccacttcacgcagcttagtggccatggtgaagcagcgatccatcaaggatggctttggtggttgggcctttttcacaggtgcagtcacaggggcctccacgggctttttagatttcgggggtttgacattggaacggaaggtgagcatccctgtctcggttaccagtccagcatcgatcaggcagcgaaggcagccagagatctcagctttggacaggctatgtttctcaacacgggccatctcgttggagatctggccaatcgaccagaactcctgcatgggtacagcagcgaacacctttcgggccagattggtctggccggacaggatgttttgggcacgttcgtattgcatcagccaagttcctcagtgatgagttccgacagtttccgagcgttctcttcggctgccggagtgatggcagtaatgtccccggaatgcagtagaagattcactgcccgcaggatggaacgcattttgtggatacgctccccacgctcaacactgattttctggtgatgagcagcgttgctactggcgacctcgacttgaagactcagcctgccctcgcttggccgcacgaacagctcgcttccctcgggagcgaggcttagatcgatcagggcgataccaatcctcatcggaccaatccccggaaagtcgtactgaatcgaggtcactttccctactgggctcagcagggacttcttctcgctggtgctcatgtgtctcttccttcaattgggcaaccaactggttgcacttttcaatgaacgccatgacagcgatgaccataggtgcatcgtccatagcgaggaacgccttgagcatcttctgatgcttgagcggaaccaatgggatctgtgcctttatgcagtcacgcagccgggccacatcgttgttgtggtaggccatgttgaactccaaggaaaacgcgacctcatcgggagtcttatccccacttggttccacaacccggaggttctgcatccatttggggatatcgaagacattggaaggttttttctttctcattactccgacctaaaaaaatgaggcccgaaggcctctaatggagggatgttggtgcatccgaggtgacacaacagcaaggacagtgattgaacacacgtctacaggtgctgagtcacctcggatgcaccatcacaaggatggtgcatccgtttgaggcgctcgccttgcggctagccccggcgcggccaggaagtgctgtttactcggcgctgtcgcccttggtcaggcgattgacgacggtctggtagctttccttgacggtcacttcttcaccggtgtccttgagggtgatgaccgattcgctgccagattcactgacgaaggcgatggcatcggcggcgatcagaacacgttggtcggtgtcgtaggacttcagtttgaggaacttggacatgcttttgtatctccatgaatgcaactgggaaggcagttgccacctataggaaaggtgcccgcttacatatacgggcgtgccccttaaagaactcctgtgtactgaggacttttccacagggcgtggggaagaggtgcccgcagagtggattcgaaccactgacctccggcgaccggcgagacgtaacgggagctaccctatctctgtggtggccagtgctctaaccgactgagctactttgggcattgaaagctacattggccgatcaacagtgagggcgtccccactgtgttgtgacagaacggaatcgaaccgcagctgttaatggtcttcgagggtaaatctctacttgttactcatgcgccatgcgccttacagagtgacccagcctgtctcctacagcctgttgatcgccaatgcagcttcctgtgactgcattgggctttgtccggtatgctccggtctttccggggtgattcaccccaagaaaggctagctttcctaacccgctagggcagaaaaactcagtggaagatcgggaccagagacggtcgcctcttcgaactgcccttgtgccttcttgatgaaggcccggatctgacgagccgattccttcacttcgaagttcaagttgtcggctgcttggatcagcgagcctttgccctcaccattcagctgttcaacgctgatgatttggtcggaatttaggtctacccggttgccgttgctcagccgggtcactcggatgaaggtcatagttcagccctttcaatgcacggggctttcccccaagaaacagctcggtgttgcatgctgggcacgtcaacctaccgtctgcaaattcaacggtgtagtaccgtttgccgcacttgcaagcacggaaaccacggtacaccccattagtgaaaaccacgtcgccgttaccgttttcaacacagtcaccgcaaacgtgggagtacatcgggtcgatgagcatccatgcgttgggcttgttacacccttcgcatggagcccccggatcaggtgcaccagtcacttcgattcccgagccggaacgggacggtcctcttggtgttggtacttgccctcgtagtgggcaggctgacttgtccgatggaagatcacttgagcgatccccgaaccagccgggatcagcagttcttcttcaccgtgatagaccagctcaagggtcagaaaccctttccaacccggttcgatcacggtgttgaagacggacaggccacgacgagcccaagtggacttgtcgtggacgatccctgtcagatcgtccggcatctggaactcgtccatggccgaggccaaggcgaagcgaccgaccttattcgtcagccgtctggctaactcgttgtccttttctgtttgaaaagattcaacgtgcatgaggcccatctcaccttgacgccggaaacgcatagactgcttgatgcggatgtcatagccagcctcgctgagtccagccgaggtgccacccttcgcaacgaacttggtcgtggccatgtccttgatcggggcagcgtcgagtagtgcagtaccattgatgatcacgagctagttcctcatgtgaatcagtttcccgaactccaccttgcgaccagcagcacgcacggcacaccaaatcactgggatgtcgaaaggcagcttggccatggggttgcagtcaaggtctgagaagacgatggcagcagtcggtcggtgcttcagcatgtgctcacgcacacacaccagcgacgtaccaccagtgccgtaacggacggtttcctcgaagggatcctcatccaagaaaacgctctcatggacaatcgagcacgtgaactgcaccagcgtgagtttctcaggccggagcacttccttgatgaatttcacctcggagttgaaacgcagcacgtcgtggttggagcaactacctgacacgtcgaggtagtacacgatgtgccggagccgttcttcttccatcgtcaccgatggcagatagacccggtgggcgtaacggcgattggggcgagcccacgagtagccgttttccaccagatcagtacagaactgcatcagctccttttcccatgggacaaccggggcaaggaacttgtccagcgtctcctgaatcacttgagggatattgcccgaaccaccggccagcttgtgttggtgaatggcacggaggaccatctcaacgaccttctgtgcatcttccttacttggttcccttaggtcaccattgccccagtcaccttggcccaagctgggcattggtggtggtgggactaggacaccggagctgatcaggtcgtagatttcttcttcggccagtcggccattgtcgtcaatcgacggatccagacagcaccactcaatgtccttgaaactgaagccggacacgagcaggtcgttgttgatgcggtagtcacaggcctgattccagatctttggatcacgcccggcacgacggatgccgtgcagcagggccggatgccacagttcgtggaccaacacggttgcccgtgtttctggggtcagggacatgaagaagtccgggttccaccagaccttgcggccatcggtttcagcggtccgcaccgtttcgtcccacacgaagtccaacgagcagagcaccggacccaagaaggcagcagtgcccttgttcatgaagaccttggacttggttttatccaactccttgtcgagtgtttgctcgtcgaagttcatgatcagtcagcctcgtaggtgtgttgggtacgaatgcccggcaggtgaatgcgtcggcccatctctttcaggatgtcctgacgttccatgatccgcttggtgatgcgttccttcatttccgtgatcacggcttctacctgatcaggattgccagcccacgccttgaagtagcacaaaccgtaggtgtccatgacctgctcgggaacaccgagcttgtcgaaggccacccgacggttgttctctgtcttgaacaaggacgtgcaacgttttgccttataatcctcgacgctgaccttgaagccgtggtcatagccgggagcattggacagcatcacacccacacagtgaagcgtgcaattgtggtccattggttcagtccttcaggtagttggccagctccagcatagccttgacgaacggtttctcctgacggagggacttgtcggtgatcatcaccgagcggaagaacaggatgcggaacgacaggtcgaagcggttcgcatagcgagacagcacgtccagcgtgtccttctccacgtgctccagcagggacgagatggtcgcccacttcgtagcgttatcccgagggatgaagtggttgtccgggtcgttcatgatgtcgtcgatcttcgggatcttgtcgaaaacctcgcagaacgtcacgaagtcggcagcgatcccagccgtgatggtgccagccagcaacggcgtcttcccttccagcgaacccatcggcccgatgatgcggtgagcgaactcccacgtccgtggacagcagaacgtcttgtcggtgtgatccggcttgaagtccatcaggcggcccggatactggttgaggtacgcgataacacgtttgtcgtacttctgcggcaaggccacgtctttcagccactcttcgaagtcttccaccatctcgatgtggatcacacgagactgcatggcagtagacagagggttgacgatggcccggtcagtggacaggttaccggcagcagctaccagacagttgtcgtgcagcttgtgttgcccaaccatgcggtcgaggatcagcttgtaagcagctgcttgggtgtctttcttggccgagttgaactcgtcgaggaagatcaaccagccgctgtagcctttggggatctcggcatcagccaatgggaacagctcacggaacggagcgaagtaggcgtagccatccttgaagtcaggcaggccggacaggtcttccggtgggctggtgctgagccggtgatcgatcaggaacaggttcagctctttggcgatgctcgccatgatgctggacttgcccagaccgggagacgactgaaggaacggcaccagaccggcatagagcacgtcgagtacgaactcacgagcctgtcgtggggttgaacggtacaagctctgggcattagttgccatgtcactcttcctttgcataagggaacggatctgggtattgcttacgcagatcgtcgaagatggaaccgaagctccagctgaagaaaccgggagagtagttctccacggtttcgatgagacggccaacatccttctgttcgaaggtgtactcctgttggccgagatactgcggcaggatggagccgacatcagtctgctccacgagtgctgccacccgagaacacgatggagggtcagtgatgtactgtctcccttggttcagtgggatcatcccttctccttggcccgttgggcacgacgtttctggttggttttgtggctgaccatctccagatggacagggttgcagcacaagcggttgttgcacttgtgatcaatctgcttcttgccggggatgtagccgtaatagtgggtgaacaccaccaaatgaaccgctacggtttggctgttgagggacatgcggccataaccaccacccttgccgtcacccgaatcggggccggtccagatgtgacatggacttggttgcccatccacggtgtagccaaggtctttgaccatgacacgctcgtagatgcgaaagatgatctcctcccgacgagatacgtcgatgatgtccccaacatcaggcggaagggcagcggtcactgttgaacttccttccacgggatcagcttgtcccgtgagcgaaggaatgcagggtcgcactcgatgacgtactcacgcagctccacggagccgaggtcaatgcacttctcagcgatttcacgctcgatttgttgctctgcgaccacgtaggtagcacctataacagcagcagtccataaacagaataacgcgaagttgtccatgtgattctccttgattcaggaaaagaaaaccccggcacatggccggggtctgattggtttttaaccccaaggaagggctacgtggcttcttgagccactactggctgtttggggatggaggcctcatagtcagcccggatcttagctacccaagcatccatgaaagcggcaatggcctgtttgccctcagcagtttcgaggaaggccgggatgccctgccatgcctgagagacgaagatttgcccctcttggttcagtgcagcaccaatggctgctttggtgcggtcgaacattgccagttcagccgacaagtcacgtcccatgagttgggaaataaccggtaacaaactcttgatgtccatttatggttccttgctttggtgggtggatgcctcaagggcatcgcggattcccttgctgatgttgccatcaccaagtttcttcgcttggcgaatgtgccaattggggagacgtgctgatacacgctggaggggttcgtcttgatcgctgtagacctttggtcgtcctactgctcgttccatgactgtatttcgtctgacaaagggaacttattatggccacgtcgaaagacaaatctccacccacaggaatcttcccatggacctgtctactcacgaagctgcatcgcagcatcgttacgaaaatcttctcaaagcaatcgaggaacccaagatgagcgaaaccaaaaacttcttcggcactgacggcaacggctccaacgctggctggggtgctggtgtcggtggtctgatcggtgctgccatcggtaatggcggtggcctgttcggcggcaacaaccgtgaaactgccactctggatcaggtggacagccgcttcaacgccctgcaaggtcagctgaatgccaaccaagtcgaagatcgtatctccgatgtcacccaagctgttggcggttcggctgctgctctgggcctcggtctggccggtgtcaaggatgccatcattgctggtaatgcccagacccaactggctctgtgcggcctcggtcacagcatgcaggctggcttcgcctcggtgaaccagaccaccttgctggaaagcgctcgcacccgtgagctggcccagcaaaccgagatcaaccgtctgctggccctgaccgcccagcaacattccgatgcgggccatgcccgtactcaggtgctgctgaatcaggtcatctccgcaaagtaactccgccatccggggttaccgatctgagcgacgttgttgctcagctcacccggatggcagatgctgctgttgccagcaacgctcaagtggcttcggtcatcggggctgatgctaacggggttgaccgggttcgcaccgaaccactggcaccgtaagccgaaaggcattgagaaccccctcttttagggggttttcttatatctgaggtaaggaataatgaggcatttccccattttaattggtgactctttgccacaaagtggtcaaccagttcgtgaaccatatcgggtagtttggaatactgccgtggtttacaacgaccagcagcagtatttcaaacaacaacaagaagggcattttaaatcttctattctgaacacagctatactcactgatcatgagcctctggattttgagcccaagatgctcatgcttgatttcctgcctttggacgttaatctgacgggtttccctgtactcaccgcctctcgtcctaaataccctatcgttggtatgcgtgttaaccgcatccacgatattgcgaatgcggataggcgtaacaaactccctaaagtattccagtctcagttcaccagtaccacagttttcgaggaaatggacttctgtcgctataaccttgatgcaacaggcacaaagtatctttcgctccggttggtcaggagtgatgtggaccttcgcgcccgtttacgttattgcctcgatgggcagactgtagttaacagcgcgtatgctgagattcctggtcctaatagcggcacggtatctactgcctccctccgactaattgttttcggtgatcgtctggaattccacttgagcgagccaggggataagcttttagagcttccttttgtcggtgaagtggtgagttcctcttcctccttcttggaaatgatccgtgaagatgacaaggaggacggccaggatgtgcctgtgctgtacgccattgatggcctgtacgtatacgatgggtattactaagtaaaataaaaaagcccctcaagaagaggggctttttgttggtgcctgttacggcttgcgtggagtggtccacgcctgcaccggcaggaaggtgcggaagtggctgttaacgatgcccacttcaacgatggtttcgccatcgccggtgaactcaaactcccacttgccatcagtggcacccgaacgggtcacttcgatcaggtcagggttttcggccttgaagtagtagccgtccttggtggcgtcggcaggcagaatggtgaagtccagcttgatggtttcgccgggcttgacgtaggtgtcggtgttgttgaacaggaagccagtcggcagcacgaaggtgccagcgttggtcagcttgatcttttgcatgtcctgaatgccatgcttggtgtacagcagctcctgcacgtggctgtagatggcgtggttgatcggcagcttctgggcaccggacaggttgtccagatcctcgtgagtcaggtcacccagcagcacgtatggagcagccggagcactgtcactggccagacggatctggacagtctgcatcaggttgctgtcacgagtggggttgaagtagctacgtagtttcattggttttcctctgatcagaaaaaataaggccaatccccgaagggactggccgtagtgtacatcaggacagggcatactctgacatcaggatgtcgtctgccaaagttgggtctagcttaccaatctgcaccttgtggcccatgagctgggacagcaggtcgctgagcatgttgctcttggcgatcaggtgcagttgcaggcggtactgctgacgcaggtcattgccgtagttcggcaggcagcggaagcagtcatggatggagaacacctcgaacggcttggcaggcagactgttcagcagttcaacgatgtcatcgacattgaccagaccgatagtctcagtggtcaggtgatccaagatacgagcagacaggtagccagactgctcataacgctcccacagcacacgcaccatttcaccgtcttcgccgttgtcatccagatcctgcggtgcagggttctcgatggcataacggacgcgggcaatggtcttggggttgtagttgcaacggcgaccgatctcacgaacgatcatgccgtcgatgctgtgggtggtgttggcagacagtgaacgaccttcttgggtcggacggttcaccttgatgcccacgtcgaagtgctcaccattgaacagcacagtgctgtagtcaacgtcgattaccttgcagtggacgtggaagttgtcaggcagtacccacgagtagatagagcgggtgctatcccacatgtccttatagtacttgttgagttcccatacagctgggcactcttcttccatcgtctcgtggaacttgacgagcagtggcccgttgccgaacacacgcttcgggatggcctcgctgttgtacaggctggtcatcactgcggacttcaccatgtcacgagtcacacggccttgctgaccaaccttggccagcatcttcatgtagatctcggtgtaggcgtcagcacgacgaccgatgttcaccacgttgcacagcatggcagcacggcggtcgccagtcaggcaggccaaaatctgcataccagaggcagtggcatccagagcaatcgggtatcccgttggttcgctcttttgaacagcgtcccatgcctgaacagcagcgaagtactgagcaggtacttcagctttattcaccatcatgccgaggcagtgtttgtggctttcaaaccactgaagccggacttcccagtcctccttgtccaagccaaagtgattggcgatgtccatctggaggtattgtttgccggtgaattgttgagtttgcatgcttcttctcctaatgagtgcgtctttgcaaatgagggattattcaacgagttctttattagcgaactccactactgccttgttccaaggagcaccttggtagttcacgtggtaaccttggcagtaactgcgaccacgtttgtcatacttgtgtagcaagtggaactcgttcttgtgctcagtgatgatgtcaatcacctctttcgcagtacggtcatacttttcaaacgcctttttacggcgttcaaagtcttcccttggttcattcggtttgggtttgtccaagcctttccacttgttcttgaccatctccacaacagtgaagttgattgcgaacttgatgcggttctgcctgttgatatggtccagacagatatcatcctcatggtggttattcttgaggatgaggctgccaccggtgttcagcatgcccgtatcacggttgcatttgacctttcgtggcatcactaccattggcagtggatattgaaaacggtccagctcatcctgcacatcttggctgatagttgccttgacgatgaacaggttgaagtgtggcgaccaatctacgatgtctgccacagcacacttgtacagcatgtcagcagttgcctgcggatcatcaaagtgcttgttcataacacctaccaaagttggcaggtcacagcgtttgtgcaagttcatctgaactaacaaatcgaagccgaaccccgttgggatatcattggcctcgaagtaagcagcaaagtcaaatgtctcgcagttgatgaactcactcttgatgcgagtgatcagttggttcttgttgaacaacacttccagctcacgctggtggttacgcagattgattgcatcttgagattcattagtcatctcggcttccttcattatctggttgaggttgtgttacttcacacgtttgagtgtgttgttttgtcgccagagctttacttgctcagacagacgcttgtgtagcaaataccagtcgtatgtgtattctccaactctcagcaacttctttcgaaagtggttaatccagtactcattatgctcacgtgagtacatcacgcaccctccacaaagtagtcgtattcttcacccaagtagggtttccacttgatgtcgaacatgcagttctttggggcaccaacgaacatcggtgcaatctcagcatccttgtaaccggcaaggccacaaccaatgcgagtgacaaagaagttgagcttgcgtttgccagtagcgaaggccaagaagccagccacgtaggcattgatcatgtctagcggcaaggactgtatgtcctcgttcttggttggaattgcaaagctatcaccatagtggccatagcccttgccatagacagcaccacactttctgtaagcgtgagctgctgcaccggcaccatgaatgccagcttcgttggaaccgaacacgaacactttcttagccattgacttgcttccttggtttggtgacacggacataacggatgtcttgatggggtttgcagcgagagcaatcgcaatgagtcatgctcttgccagtggtacggcagacgactttatacacgtagactccaacggtagtcagggtaggttttggccacggccttgagcagcacatcgctgatcacatggccatggcatgcttgtggagcacagaagcattgcagtttcactggtccatcaatggccagatcagcaatgcgttgcaactcattgatgacagtggtgttgccttggtctatctgctgttgcaaccagacctcgtatttctcaattaccacgtcacgtgtattggcaccttgaatcgggaatggattgcccaatgggctaccacgaccaatgtagatgccagtttcaccatggtgcttgttcaccacacgcaggtgcaggaacttctcaggcctgttgagccatgcctgttgttccttcttggttcgacatttggcacatttgccatctgcaccacagtgcccacgtttacaacgacattgcttgctcatatttacctctaacgaaaccagttattgaggatttgggccagagccacggcttggttgatgctggtgcgagcgaactgatcactgagcttgttgccattctcagtggccttgtcattcaactcggccatcaggtcgagattgtggattgcccacagttcccacagatgcaggtagtgatccttcagctgtgtctcactccagtcgatgacaggtggcttacctttgcccagtttccagttggttccaccaatgtcatagcccttgatgtcacactgataccactgttcaatggttcgtccatcaggcatggttgccaccaatgcactgaagcgttgatcaccagcagtactgcactcgtagccaccaccaacattggcacgcacccagtttgggctgtactcacaggtgctggtgtagatctcaacggtgtcagttgacccgttgaccagcaactcagtcacaagctcacggccatggttgttgttccagtggaacacttgcaaatcaaaaccagcaccaccttgagagatgatggtgttcagttgctttgcagcttgttggactttcattccagctccctcacaattatgtctagctcgaccacacacacgtcttcaagacgacgatgcttctgtggtctaatgctgatcttgtcgagtacgaagtagcatgggccagaagaatacggatcgtctggcccttcccacccaccatgccctttgtgaatgcccttggcccagctacgcatggcttgggctgcacccttgtagctcttgaagagccgaggtgtcttttcagtgattggacacaactcagctttggagttgctgcccttcacccatggcagatacagctcgccatgaatggacttgacggcgaacagtttcatgatccctcctatttatctctatcgaggcaatggtacgtggcaacggatggcatggttggccatgtcccacgtcattttggttccaccatcagcaggcacatcaccctcgccgaatgtgaaggcaaccatgtgtgtgcattcagcagccaccagtttgttgcgattggccatagctgcataacctttctgcactggttgagtggtgaaggacacactgttgtggctcaaagcctgacggatatggtctatcgaatcgaagcccatcttctggctgaactgcttgtgataccagttacacgctgccccactggttccgtactcgcctttgaagcagtgacgatcaaacggagcaggcagatgtagatgcagttcttttaccagatcagtaccaagtgcccagacggccacatggtcagcccaagcagcaccaccactgacaagaatgtcatcaggttgcagctcttcagccagagtgctagtcatgaactcccaatgagcaggggtcatgggaatggttttgtcacgaccagcagtgccaattacagcaatgattcggctcattggatcagtcctttcagttggcgagtgagtttgaggatctgtttgtcagcttcccatcgtgagtagatgtcagcatgaggcagcccatcgatgtagcggatgcgttgcatgatttgctcagccgtcagggtcttacgcttgaagagatggaacattttgttcctcctatttatctctaagcagcccttgattaggttgagctgtctttagtgaattgggtgtggttttgttctacttaccatttaggttggagtaggatttgttttaacttcggtgatggtgatgttcatgtactggaagccacgcttcagggccatctcattcagctggtagctggcgatgacataggcatggtcacggtcaagtgcatctacttcgatggtcccgttgtagataccactctgccactcaatacggaattgcttgcacagatggagggtgtgttgagctgcttgaggcatcagtctatcggtcatgaatctatcccctttgggagcctatcgaagttaaagcccctagtgcccttgcgggcaccagaggtagagcggttagaacgacagcttcttggcgaaggcgttgttgttcgggtcaacaggtggagcttcttcgtttacacgacgcagctggatttgcaggttgatcaccgaggattcgcccggcttcaggttctgagcgtgggcaaccagttgatcgagcaggtcgttgcgtgcagcttggaactgagcgaagtcggaattgcgggagttggtcttcaggtgatcctgagtgtccaacgggatgccttgaggcaggctgatgaacaggttgttgccgtcgtcgtcttgcacgtcggactcgtaaccgatgttcagccagtactcagctttcggacggtcagcagcaggagtagcagcgttgttggttttgccgaaggttttcggagtgaaatcgatggacatggtgaatctcctaacaatggaatgaatgggcggaattgcccaagagacgcgcagcgtcttagctattgcgagtgcaactttcgtgagctacggagccaactgcaacaatggtcatgagtccaagccagattggcaggtggaagtagaacatagcaccgagagttacaccgatggttactccagcagcgagcagagtcaggatacggaagtacgaagtagtcatgggtttaactccaagtgttgggtaagtcagttgctagcaaggtgagagagcgaagtattgcggtgacctcagacaccagacatgcgaaggattgcagcggatacaccagagttgatggcccagattgtgaaggcagcgacagcgattggaaggtagagatagttcatgatttagactcatcttgagggtacacacggatgtgcatacccttgagggtggatttagggttgagcaggagtacgagtagcgttgagtttctccagttgttctggagtacggagcagggactcgaatgccttataagcagcctcgtagtgacgagcatggtcagccgacttggacatgaacttctcagccttgagggcagcagtagcacggtgctcagcacgttcctgaatgaggttctcgatgaagtcctctttgtcagcgatgtgacggatgcgttgctcatcagcagccttgactacgaatgcgttgagcatacccactgcaccagtagcagcatccagtgttgtggtaacagtggtagcagcagcctggacagagccaaggacagcaccgaaggtaagacgagtggacatagtggtaactcctagtgattgagggcgaagatgcccaagagtggcgcagccacgcactagcaagctaagtgggggtagggtcgaggtgtagacagtgtaataccgggggggtacttggcctcgtggccggtgtagcggaggtgtactcctcaatggaacatgcctatcaacattttccccatgcaaaaaattttgcagcactacgctgtctatagcaaagatagatctatttaggggaggggctgagcccctttctccttggttctaacgccccaaataaaaagcccccggttcctaaacaggccgggggctagtacatgatcaatccacctaaccggcaatccggctgaaacacccgagggtgttaggagcggtgaacctcatgctgctgctgttacatacccaccttcagctggggctgtgtcaaaaaagcatcgtcgcagtgcaagacataaattagacaagtcctgcattgctgtcaaattctgtttcggtcacccggatcccatgtcatgtagacggagccggggtacgtatccatccggtactccctcatgccgatgtctcgatccaagaactgaattttgatctcacacccgtacaccagctgcatcgcccagaagaagtcgtactcttcctgagtctctacgagcatcaggttcttggaccgggagtagatttcctcccagtcttccaccttctggtcacaggcaaacttggccgacttccagacctctacgttcatagcaggtactggatggtcgagagctgggcagtggactgggaccaatgagtcttctcctgcacgttcttcttccacttgaggtcaccctggtagtccatcatgtagtcgaggaaccgggggtcagtgcagaagatcgggtgtggtccaaggtagcgcatcaaggactgtgccttgtactggcccggccagtacccatcgtgcagctcttggaagtcaacaaggtcaacactgcccaagataaattgcatagagaaaaggtaggcccgctcttcgtcacccatggcgatgaccttggtattaggtccccaatcaaatacctgatccaaggtccagacattgctgtccctgttcaggtcgttgaagtagtagaaatgctcagcgatcatggcgacgtaccgaggtgcagaagtaaattggaagaaggtctgattgtttggtttcgatgaatgtcttgttcccatctaccgacaacccggcgtagtcagttttgcctcgttggttccactcatcccatgtcctgatgtctacctcccgaccgaacatcaactgcatggcagtgaggtagtccttctgctcttgagtatcggtgaggatttggaacctgacgttgtaggtgaaaacaaactcaagggggatggcaaagttaatcaacaccccattgacgtactgcacaagcgtttcgatcattggagactccttagaaatgagttagactaaagggagtctaaaggtcaaccgaccttttatccaccccaaggaacccatcaatggaaaaccaacaccgtctagttaaaggctaccgtgaccttaatcagtccgagattgacgccatgaacagtatcaagctcgctgagcaggacatcggccagctgttccagcagatcaaggccatgcccggcgtggaccaacgttccatggcactggccaagaccggtttgcaggaagccttccattggttcatccgtgccgtggccaagccgcttgacgtgtacgagctgaagctccctactccagctcctgtcggcaagatcgccagcatgagtggtgtgggccacgcagttggaaccaaggagatcttcttcgctccgatgagccgggccgactacaatgcctaccgtggctgggtattgcctgaagacgagaatggtgaagacgagggcttcctcgttgaataccttgacggtggcaaacctaacgtcgaaggtcaccccggctatgtgagctggtctccgaaggatgtattccttaaagcctacggccaatcgaagtaagacaaggaggggactacggtccccttctccacaaaaggaataacgaaatgctgaccgtcgatgacgtaagccaagcagtaccagcgaacctcaagtcggcagtcactccgcagttcgtcgccaccatcaacaactgtgtggccgacccggagattgccgaacaggtacggaacaacttcatctcgtttgcctctgtcctgcgtgacggcaagtacaagatgcaggactacctgaacgccgtgacctacgtgtcctacaagatgatggacatgagtaaccacgacgcatggtgctcgaccttcccccaacgccatgcagcactgatcgcagcaggtaagggcaagaaggacatcagctcccacgtctccatgtactcgaagggcaagctcgtcgctgccgtcatggaagccagcttcatccctacttggatcctcaaccgggatatccaacagaaggcgatcaaccgtctggctgacttgatgatgaacgctcagtctgagaaggtgcaggctgaagctgccagctccctgctgactcacttggccaagccgaaggagtccggcccgctggtgaatatcaacatgaccgagacttccggtatgaacgagatgaaggacatgctggagcgtctcgcttcccagcagcaggaactcattcgtaacggtgtgaccaccaaggaagtggcaggtcagcgtatcttcgagaacgccca

SEQ ID NO: 16 - DNA, 43210 bp, unidentified
  misc_feature 1..11: note = bacteriophages nucleic acid sequence
  source 1..43210: mol_type = genomic DNA
tttggccgactggcgaagaactgttgtttcgccacgtaaaaaaggtcgccgattacgaaggcttccacggccacgaatacccgtatatcggatggaacgaattaacgaagcatcctagcggcgacctgtacgacaagtttatgtcggtcaaccgcgttacgttcgatccgatcaaagacacgccgaaagacccgaagaccgggcgttatttgacgcctaacggcctgccgttgcccgaaattaagtgcgaagtgttcagcacgacgaacccaagcggccccggtcataattgggtgaagaaacggtttattacgattgcgccgcgcggcactgtcgttcgtcgtagtatccagatttataacccgaagaccgaacaagaagaaacgcacgtaattacgcaaattgcgatcttcggttcatacaaggaaaacccgtatcttccggcgtcatatattgccgaactggaaagcattaaagaaccgaaccttcgcaaagcttggttgtatggcgattgggacgttaccgcaggcggcgcaatcgacgacctttggcaatcgcatatacacgttgtaccgcgctttgtcgtaccgccaagctggcgcatcgaccgcacatacgacgacggcagttcgcacccgtttagtgtgggctggtgggcggaagcggacggcaccgaagcgactatcgttctttcggatggaaccgaatacgtcttttgtccgcaaccgggttcgttgattcagatattcgaatggtacggatgcaagaaagatgaaaagggcgaattcttgccgaacgtcggtcttaaaatatcggcgtcggacgtagcacaaggcattatcgaccgcgaagtttcgatgatggcgaacggctggatttcgtcgcagccgtggcccggccctgcggacaatcgcattcgacaagttatcgacgttgaactagacactaccgaaaagcttatgtcgaagaagggcgttcgctggatggaatcggacaagtcgtcgggttcgcgtgttatcggcctacagcttttccgcgaccggctagaagcgtctgttaaacgcgaagggccgggggtatacttcatgtcgaattgcgttgcaagcattgatattttgcccacattgccccgcgacgaaaagaaaatcgacgacgtagacacaagcgccgaagatcacgtttacgacatgacacgttatcgcatgttgaaaggcgcgaacaaagcggctacgaaagtcaaagtatcaatgccaacttaaaggaatcgaaatcatgccgaacgtatcttttgtgcgtcctgaactgtcgaagttgcttcccatgtactaccttattcgggacgcaatcgcaggcgaaccaacggttaaagaagcgcgaacgaagtatcttccgatgccgaacgcttccgaccaatcgaaggaaaacaaggcgcgttatgatgcgtatatcgcgcgggccgtgttttacaacgtagcccgtcgaaccctgttcggtcttattggacaggtgtttatgcgcgatccggtcgtaaaggttcccgccctgctgaatccgcttgtcgcaaacgcgaccggatcgggcattaaccttacgcagctttcgaagaaggccgtatcgttgaacttggcgtattcgcgcgccggaattcttgtcgattatccgacaaccgaaggcaacggcggcgcatccgtcgcagaccttgaagcgggcaagattcgcccgacgctgtacgtctacgcaccgaccgaaattatcaattggcggacgattgatcgcggcgcggaagaagttttgtcgttggtcgttatcttcgaaacgtggtgcgttcaagatgacggcttcgaaatgaagaacagcggtcaattccgcgttttgcgtttggacgacgaaggttattacgtccatgaaatttggcgcgaaccgaacccgaccaaggcggacggtacgaagattccgcgcggcaattaccaacttcacgaagttttcaaacctaccgacgcgaacgggaatcgtcttgacgaaatcccgtttatgttcatgggttccgaaaacaacgacgttaacccggataaccccaacttctacgatcttgcgtcgctgaacttggcgcattatcgcaacagcgcggattacgaagaatcgtgctacgtcgtaggccagccgacgcccgtacttaccggcctaacggaagaatgggttaacaacgttctgaaaggaacggtcaacttcggatcgcgcggcggcattccgcttccgaccggggccgacgcaaagctgttgcaggccgaaccgaacaccatgcttaaagaagcaatggacacgaaagaacgccaaatggtcgcacttggcgcaaagcttgttgaacagaaagaagtacagcgcaccgcaaccgaagccgaattggaagcggcgtcggaaggttctacgctgtccagcgcaacgaagaacgttagcgccgcgttcgaatgggcgttgaaatgggcggcgcgctggatcggtgcgggcgacgctggcgttaagttcgaactgaatacagatttcgacattgcccgcatgacgccggacgaacgccgccagattatcgaagaatggcagaaaggcgcgattacctttaccgaaatgcgtacagggcttcggaaggctggcattgccaccgaagacgacgcgaaggcgaaggccgacattgccaaggacaccgccgaagcgatggcccttgccatgccggacaacgtaccgggcgacggcaacacgcccccggctggtaatgtgggcaacgggggtgcgtaatcatggcgctatcggataacaagcgcctatacgacatttcaacgcggcttgccgtatatgtcgaaggcgtcaaagttcagcagtcccgccaattcaacttcgtattgcgggacattagcgaagttcttaaaaagcttcttggtcgtgttcgttataaaacccttgacggtctttcgaaggcgcaactaaataagcttgtcgcagaactgcgcgaatcgcaatcgaagatttacagcgcgtacacgtcgcagcttatcgaacagcttaaagcgttcatggctgcggacttggaagtaaaccgccgcgcatgggttacgggatatatcgaacttgacggcgattcgccggacgaaatcatttcggacgaagacgcaatacagttcttaatcgaagccaacgacagcggcgcaaatccgttgttcggcatcgcggccattactggcggcgacgaacgcatttggtcgcaagttacgaattcgccgcttccggcgaacgggctttatcttctgccgtttatcaagacgtttacaacgtcggcgcaagcgtcaatcgaaagcatcattcgcaaggcatgggcgaaccgctggactgttgacgaaaccttgcgcgaaatcatcggcgaagaaggcgcacgccaaggcacgccgtcgcagcttgcgcggatcaacaatcaagccgcgtcggttatccataccgccttcgcgcatattgcagcaatcgtagcggctggcgtagcgtctgcggttttcagttggtacgtttggttttcggttatggatggcaacacgaccgaaatttgccgaagccgcaatcgcaagcgttatcggtttggggccgggccgttgccgcctgcgcacattcgttgccggtcgcatactgccccggcgaatacggctagtgacctaatcgacgaaacgttttatacttggcttgcgcgtcaaccgctggaagtgcaagacgacatattaggcaccgaaggcggcgaagctttacgcgatggcaaattgaaagcttccgatattccgaagtacgaagccgacgaaccgctaacgcttgacgaattccgacgcaagattaaacagattctttcccgctgatacggtgtatcggcataacctgtaggagtcctacgaaatggcactgaaaaagcgtattaccaaagaagaacattcgaagcttgccgacgcgctgaaattcgaatatgtcgaagacggcgacggcttccgtctggacgttgacggcgacgaagacaccggcccgcttcgccgcgcgaaagatcgtgaagcgcagttgcgccgcgatgctgaaaagcgcgccaaagaagccgaagaccgcttggccgaactggaaggcgacgacgcccgcaagaagggcgacattgcgacgctcgaaaagtcgtggcaaaagaagcttgacgaccaaaaggccgaatacgaaggcaaggtttcgaagcttaccgcgcatacgacgaaatcgcttgtcgataatgtcgcgctttccatcgcaaccaaaatcagcaacgcacccgcgattatccttccccacattcgcgcgcgtctgcaagcggacttcgaaggcgacgaaccgaagacccgtattcttgacaaggacggcaagccttcggcaatgaccatcgacgaactgtcggcggaatttgttgcaaacaaggatttttctgctatcatcaccggcagtaaggcgtccggcggtgccggtaagccttcgcaaaacggcggcggtgccccgaagaatcccggtcaatccgacaaacccgccgacctttcgaagatgaatccgcaagaacttgcggcgcatctgaaagaagcgaaggctactactgaataaggacgctttatcatggcactttccgacctcgcggtttactccgaatacgcctattcttcgttctccgaagtcctgcggcagcaaatcgacctgttcaacgctgcaacgggcggcgcgatcatccttcaaggtgcggcgcaccaaggcgactttagcgacgtggcgtttttcgccaaggttgcgggcggccttgtccgtcgtcgtaacgcctacggttccggcgctgtcgccgaaaaggtgatgaaacaccttgtcgatacttcggtgaaggttgcggcaggtacgccgccgattcgccttgaccccggccaattccgttggattcagcagaacccggaagtcgcgggcgctgcgatgggccaacagcttgccgtcgatacgatggccgacatgctgaataccggccttggtgcgacctacgccgcacttacgcaggttgcggcggtcaagtacgacgccaccggcaacaccgcgccggacgacggcccgacttggaacaaccttaacaacggccaagcgaagttcggcgaccaatcgtcgcagattgcggcatggatcatgcacagcacgcccatgcacaagctgtacggtaacaacctgaacaactccgaacgcctgttcacctacggcaccgtcaacgtgattcgtgatccgttcggcaagctgctggtgatgaccgacagtccgaacctgtttgcggcgggtacgccgaacgtctatcacattcttggccttgtgccgggtgcggtgatgatcggccagaacaacgacttcgacgcgatggaagaaggcaagaccggcgacgaaaacctgattcgggtttaccaagccgaatggtcgtataacgtcggtgttcgcggcttcgcatgggacaagggcaacggcggcaagtcgccgaccgacgcggccctgttcacttcgacgaattgggatcgttacgccacgtccgaaaaggacttggcgggcgtgatcgtcgaagttcactaaccaacgaacaaacgggcggggcttcggccccgttcgtttagtcctttcaatcattcggagaaacacgaatgaacatcggagataatgcaatgaagcctgcaaaaattctgtacttcgtcgatggcccggccccgacccccgaagatttcgccgcagccgccgaactgaacgcaagcgtttcgttccgcaacgcacgcgccgtaccgtccgaagcgcattcgctggaaatctgcgacggcgtggcgggcgcagttccgcccatctacgccgaaaagttccccgacgccgccgaagcgatcaagaagaaggccgccgaactgaaagaacttacttcgaaggtcggcgacagcccggcaccgaaggccaagggcggcaagaccggccagcaagcgccgcagcagccgcagaccccggcccccgcaactggcggccagcagcccgcagcgggccagcaaggcggcggcgcgccgtcgtggaacccgaacccggcgcagtaaggccgggcgcagcgtagggcgcggcctgttcgcctagtgtgggcaggccgtttttataggcgcaacgaaaggacaaacgaacatgcaacgcattgtctattttaccgcaggtattaccccgacttcgggcgaactggccgacattgccaagcttaacgcagccgccgaagccgcctacgaagttaccgtagtcaacggcgcagcgaatgcgaagtatggcgaaacgaaccgccttatcccgtgcgatttggtcgcgggcaccgtgccgacgatctacaacgcgaagccgacgattgaccccgacgcaatcccggcgcgcggcctgtcggatacccaagccgtcgtcaacgacgaacaggttatcgacacggcggacggcggcaccgtaacgcttaccatcgttgacggcgaaatcacgaatgccgtttacgccgctggcgcataaggattcggcatcatggcaattactatcgtagtcgaagacgggacaggcgttgcaaacgcgaacagctacgtaagcgtcgcggacgctcgcacgtatgcaacgaatcgcggcaccgaacttcccgccgacgatgacgaagtagccgcgatgctgattcgtgcgacggactacctagaagcgcaggaatgccggtatcaaggcaaacgcacgtcgccgacgcaggcgcttgcgtggccgcgtactggcgtattcctgaactgcgatgaagtcccgtcgaacgttattccgaaatcgcttatcgccgcacaagtgcaattggcgatggcgattaacgcaggcttcgaccttcaaccgaacatttcgccgcaggattacgtaacgcgcgaaaaggtcggcccaatcgaaacggaatacgccgacccggtagccgttggcatcatgcccacgtttaccgcagcgaacgcgcttcttgcgccgctgttcggcgaatgcgcttcgaacaagtttgcacttcggacaattcgggtttgacgtatggcacgctttgaccgcgcgattcaaacggctttgcgattgatcgcaaagaacggcgaaaaggtgaaatggcgcgttattgacgacgcagccgcgcccgatccgtcgcagccgtggaaccccggcccggcaacgcccgaagacaaggacgtaactatttgcttcttgccggttgatcggcaaacgatggaaacatttacgtttatcaaaggcaccgaagttccgaagggttcggtaatgggacttatgggaaatgtcccgtttgccccgaacttgaaagacgtagttattcgggacggcgtagaacttcgaatcgcaaatatcgacgttctttcgccgaatggtcaaaaggtactttacacggtagtttttcaagcatgattgaatttgaccaagcccgcgacgaaatcaatacgctgtttcttacggcgtggaacgctaacgcgggcgcggtcgtcggctatgttcccgaaattcgttggcagggcgtacagtaccgcgatttgccggacggttcgaagttttgggttcgcgtgtcgaaacaaaccgttttcgaagaacaaacaacgctttcaacttgcgaaggaaaaccgggacaaaaacgttatacggcgtcggggcttgttttcgtgcaagtgttttgcccgaaatcgaatacgcaagctttcgcacttggtcaaacgctggcgaagattgcccgcaatgcttttcgcggaaagactacgccggggaagatttggtttcgaaatgttcgcataaacgaacttgaccccgaagaactgtacgaacggtttaacgtcgttaccgaatttgaatacgacgaattaggttgaaggagttacgaaaatggccgattgcgctatcaacaaaatcgactcgaacattaccggacttgcgtatgccgaagaagaatgcttgaagcaacttccgacgacgccggtttggtacggactggaaccgaacagctattcggacttcggcggcgaactgtccaccgtggcccgtgcgcctatcgacccgtcgcgccagaacaagaagggcacgattaccgatcttgacgcatcgggcggcttcaattcggactttacgaagtcgaaccttacccgtcttctgcaaggcttcttcttcgcagacgcgcgcgaactggcatcgaccgcaccgattaacggcgcagccatcgcaatttcggctgtcgatgctgcgacgaagacctataccgttgcaagcggcggcgcggcgttcgctgcgaacatgcttgtcaacgcaaccggcttcgcaaacgctgcgaataacggccttaaaaccgtcgcttcgtccaccgcaacgactgtcgttgttaacgaaacccttatcgacgaagccgcgccgcctgctggcgtgaaactggaagtcgtcgggcgtcaactggccgcagccgatgcgaacatggccgttacttccggcgtcgcttcgttggtcgtcaccgctggcgactttacgaccatgcccgaactgttccccggtcgttgggtgttcatcggcggcgatgccgcgtcgaaccgctttgcaaataatgtgggctacgctcgcattaagtcggtttcggcgaaggcgcttgttttcgacgatacgaccttcgcggctgcgaccgaaaccggaaccggcaagtcgattcgtctgttcgtcggcgtcgttatcaagaacgaaaagaacccggcgcttatcaagcgtcgttcgtacaacatcgaacggcagttgggccaaggtttgaacggcgttcaagcggaatacttggaaggtgcggtagccaacgaatttacgttgaacattccgcaggccgacaagttgaacgccgatcttacgttcattgcgtgcgacaacacgcaccgcagcggcgacgttggcgacgaaatcaagaccggcacgcgcattgctgcgccgggcgaagatgcgtacaacacttcgtcggatatttaccgtatcaagatgaacgttcttgacccggcttcgtcgaatcctgcggccctgttcggttacgtgtccgaagcgaacgtttcgattaacaacaacgtttcgccgaacaaggccgtcggtatcttgggcgcgttcgacacgacggcgggtaacttcgaagtcggcggttcgattaccgcttactttacgaccgtcgcagcggtgaaggctgttcgtgcgaatgccgacgttggtttgtcggttatcagcgcggcgaagaacgccggtttcatcttcgatattccgttgcttggtttgggcggcggtcggttgaacgtcgaaaaggacgcgccgattaccgttccgcttgaacccgcaggcgcggaaaacgaaaacggctatacgatgctgtacgaagtgttttcgtacctgccaacggtagccatgcccgattaagtcgggtacacttgaagggccggacttttccggcccttctttcatccatcggagtaaatcaaatgtctggactgtttaagcaattcaaaacgaattcggcgaaggaaaccgaaggcgtcgaaatcgaatttcccgaagcgcagaacgacgacggcaccgttcccacgttcatcatttcgcgcatgggcaagtcgaacaaagcgtattccaagtcgctggaagctgcgacccgtccgtatcgccgacaggtcgaattgggcaccatgaaaaacgaagtcgccgaacagcttttcatgggcgttttcgtcgataccatcctgcgcggctggaagaacgttcaggacgaaaagggcgaacccatcgcctattcgaaggacgcggcaatttcgcttctgtccgaactgcccgacgtttacgaacgtctgcaagaagaagccaagttgtcggccaacttccgcgattcggtgttggaaaccgaatcgggaaactgatagaagttctagcgtatctgttcgaactaggcccgcacgaacagaccatagcaaaacaggcgatgcgggcgggccagccgttacccgaccgcatcgccaacgcgccagaacttgaaccgggcttgcagttgtatttgcaagccttcttcgatttggatagcgaacgaacgcacgcaatgggattgacgccgattccttggacaagtattgcggcgtatgcgtcggcattcgaattcgacgaagaacagcgggaagacttgttttattttgttcgtaaactggattcggaacatttgaagaaactggaagcaaagcataaggcgaataaaggcaatggcaaacgaccttctaagtctggccgttagtctggaacgcaaggctaaggcaatcgacgaagcggcttctaaaacagccgtcgatactgcaatggctattgtgggcgacttggcgtataagacgcccgtagatacttcgcaagctttgtcgaactggcgcgttacgcttgattcgccagcaaccgggacgattgcaccgcattaccccggcattcaaggttcgtcgcaacgggcaagcgcagccgaaacgatcaacgcggcaaaaagcgtacttgcaaacaagaagcccggtcaagcgatttttattacgaacaaccttccgtatatcaaacggcttaacgacggatattcagcgcaagcgcctgcgggattcgtcgaacgtgcggtattgattggccgcaagatgcttgcgaagttcaagattaaggattaagacgaaatggccgaaaacatcgaaattaaagtacaagataaagtcgattcgtccatttcgaccaagcttaaaggcatcgcttcggatgcccgcaccgccgacagcgccgtaaaggcgttgcaatcgtcgttgaagtcgatttcggcttcgtccggtctttcgcgccttcaaagcgaacttgcacgtaccgccattctacagcagaagcttgccaccgaaacgcagaaaacgcaagtcgcaatggcgaacgttgaagcggcgttgcaacgtgccatcgcagccgaagccaaggcgaacgccgcgattaaccaactttccgccgcgcaatcgaaggccgccaccgaagcgcaacgtttggcaacagcgcagcagcagaccgccgccgccgcagcgcaggcgcaagccgcacaagcgaacttgaccgcagcgcagaccaacagcgcgaccgcatcgcagcggcttgccacggcgcagcaacagacgaccgcagcaacggccaacgccgccgcagcgcagacgcgcgcggctacggcgcaggtacagggccagaccgccgcgcagaaccttgcagcggccaccacgcgcgccagcacggcccaaacgcagggggcgaacgctgcgcagcggcttgccaccgaacagcagcgtacagccgtccagacggccaacgcggcagcggccaacgaccgggcggcccttgcagccctgcggctggcccaagcgcagcagcgggccgggcaggcgtcgcagaccgcaggccagcaaatcgccggatacgtcaaagccgccgcaggcatcgcaggcgtaacgctgtcggctggcgctattctcgcatcggcggacgcatatacgacgctgcaaaacaagttgcagaacgtcaccgaatcgcaatcgcaagtcgtaacgcttacgaaagaattgttcgacttggcgaaccgcacgcgcgcgggcgtcgaagaaaccgcgacggcgtttacgcgctttgatcgtgcgttgaagttcatgggcaaatcgcaagaagattcgttgcgtttgaccgaaaccattaacaaagcccttatcgtttccggcgcaactgcgcaagaagcgtcgtcggctttgttgcagctttcgcagggcttcaacgccggtaagctgcaaggcgacgaattccgcgccgtatccgaaaatatgccgatggttcttgacgcagtagcgaaggcgcttaacgtgcctatcaaccgcgttaagcaactttcgaccgaaggcaaaatcacgtccgaagttctgtttaacgcattccagcttatacagaagtcggtcgatgacacgttcgcaaaaacgacgcccacaatcggccaaagccttaccgtcttgaagaatagcgcaatcgaattcttcggcgaattgaacaaggcgaccggcgttacggctgcgctgtcgaaggcgattctttggcttgccgacaacatgaagaccgttgccgtcgtagttacggcgcttggaacggcgatgcttcttgcattcgggccgcagattgtcgcggctatcgtttccgcaacgactgccgtaaaggcgttcaccgtcgcgcttgcgtcgaacccgattggccttatcgccgtcgcactggcaaccgtcattgcgtaccttacgctgttccgcgacgaaattaacttgggaatcgacgacgttacgacgttgggcgatttcttccgcgcgacctttgaaggcatcgggcaggttattagcgacgtgaccttgattgtcggccaattgtgggcagacatgaccgaaggcgcgtccggggcgcttggcgaaatttcgtcgttcgttggcgatgctgtttccggctggacggaagactatacgtcgttcttccagaccgaacgcaccggatgggccgccgcgctggaaaacaccgcgaaagttcttgacgcaatcgccggattcattaccggccttgcaacgttcgccggtcgtgctatggccgaagtcgtgattaccgttcaaaacggaatcgcaaacggctataactatatcgtcggatggattgaacgggttacgaatctggcgattgaatcggcgaacaaacttcgcgcgatggtcggcaagtcggcatacgaacttgtcaacttcgaacgcatgggccaagccggacaaactgaattcgaatcttggggcaagctttgggccgaatcgctggaagacggctttaagtcccaaggcggcgcaatgcaaaaggtcgtcgaaggtcttatgacgcgcgcgcagcaaatcggcgcgaatcgtcgcgcaagcgaaaacgcttcgcttcgcggcgcaggtgcgaaccaacttagcgcagctaccgacgacaaggcggcgaaggccgcagaacgtcgcggcttggctttggaaaagatcaatacgcaacttgataacgaattgaaccgtatgtttacgcttcaaccgcaacgcgaagcgcaagcgaaaatggatcaaatcgaagaatcgttgattcaacgtaaaatcaagcttaccgaagacgaacgcgcttcgatcatggcgaagattcaggccgtccagcaagcgcaaatcgtgcaacagaagttcgacgcgatttataacgaagctgtcggcccgcaacgcgattacaccgccacgcttgaagcttcgaaaaagcttcttgaccttggcgcgatttcgcaagaacagtattcgcgcgcagtaacgaaggcgaccgaagaattcaagaacgcgcaagacccgatgcgcgcgtataaccgcgaccttgaccaacagttgcagcttttgcagttgttgccgaagcaacgcgaaatcgaacagcaggttatgcaagtgcaaaacgacctgttgacgaagggcattacgcttaatgccgaagaacttacgcaactgcgcgaacggcttacgctgttgcagcaggcgaacgcgcttgcgcagcaagaagccgcgttaatggacgcaagcgttacgaagcgtcaacagtatatcgaccaattgaaggcgattaacgcgcttaaaaacaatccgcaaagcggcttcacgcaaggcgacgcagctaacgccgtaatgaacgcgaatagcgatcttgacttcacgaataccgatacgtatttcgaaggtcaagcgcagaaatacgaagatatgtattcgcgtatcgaccaattgcggcaacaggatttgattagcgaacaaaccgccgcgacgctgcgccaacgtatttggctggatcaacagaaccaaacgcttaacgccgcgtcgggtttcttcggacaaatggcgcaattgcagaagtccgaaaatagcaagatggccgccgttggcaaggccgcagctatcgcgcaagccatgattaacacgtatcaggctgcgaccggcgcgtattcgtcgcttgcgtcgattccttacgtcggcccggcgttgggtgcggctgcggctgcggctgcgattgccgcaggcttggcgaacgtccaacaaatccggtcgcaaaataccgggttcatgtcgggcggttacactggcgacattccgacgaatgccgtagcgggtgccgtgcatggtcaagaattcgtaatgaacgcagcttcgacgaaccgcattggcgttgataacctgcaagccctgcaaagcggcgcggccagcgtccagcggaacggggagaatgtgggcagtgcgcaagctggcccggctgcggcccccgaagtcaatgtaactacgccggtaactgccgtcgtggtacaatcgaaagaagccgccttggccgcgatgcgttccagcgaaggcaaggcgtttgttatcgaaacaatcgaagaaaacggcggcactgtcgcacgaattgtcggagttaaataaatgggatacgcaatcgggacagttacgaagggcggcggcgatgattgccattatcaggttttggcgatcattaaaacgcttgccgaagctaacggatggacgacgcttcgttacgtcaataccggcaccgaccgcgaattgattttgaagggcgtaggactgtccggggccgaagaaatcttcgtaggtttcaaaacctatcaaagcgtcggcggtgattactataacttcaacgtcggccattttatcggctacattgccggaaatactttcgaaacgcagccgggcgcgcagcttgtcgccgtgcctgcccacaataacgcgattacgtatttcatcactgcggacgcgcaacgtattgtcggctgtttcaaagtcggtacgccggtttacgaacatttctacgtcggcaagttctttccttatgcacgtccgggtgaatatccgtcgccgttggtcgtaggcggcatgttaactgcatcgcaagccgtgcgttttgacaatacgtcgcaatctttcccgtatcccggcgtttattacgattcgacgaacaatcgtctttacaaccgcgatcaaggcggtaattggattcgtccgtattgctatccgtttaccaacggcaccggttctagttattcacttgcagggccgcaaaatacttcgacgcttgttccggctgatacgtattatcaagtcgaaccgatcattcttgcgcaacaaagttcaagcaacgttccgtcgaatgtttggggcgaacttgacggcgtttatttctgttcgggttttaacaacggcgtcgaaaacgttgttcaggtcggcggaagttcaatcgtcgatcaaaccggcttgacggttaaagaagccgttgacgcaatcatagctgtaagcgggcgggcgttcgtaatgttgcagaacgtctatcgtacttcttggcgcgattttatcgctttggaaatgaaataatggcatacgtcaacggtagcgccgccactatggcggacttgaaatcagcaatcgaaaccgcagccgtcgccgcaggatggacgcttacaagcggcattctgtcgaagaacggttgttatttcatgttgaccgcagcggcaggcgctaacccgcaacttttgttgcaaggtggcaccggccaaagcggttcgactttgaccggacaaccgcaatcgccgtatgccaacgcaggtacgaagattgcaagttgttcagggcaacttattacatttccggtcacgtatgaaattcatacattcaccgggccggacgaaatttattgcgttattaactacaattccgacttttaccaacaactgtcgttcggtcaatcggacgtgcccggtttgggcggtactggcgcatggtttaccgggtcttatgtcggaaactacgtaatgaccgacgatacttacgggccgcgcgtgtttaccgcaataagctggcctgaaacttacggcgtgtcaacttacgccggtatgtcgtgcggcctgttcttggaaagcggcgcagaacttggcggaagcgtcggcagttacgtacacggcgggcttgattccgtagcttggcgcaatacgggaaacggcagcgcacttaccggaatgcgcggcgcgggcatgggcgttgcttctttgttaatgcagttgccgaacatttcgaatcaggcaactattttgcttccgattaaaccgcaattcaaacgttcaagcggcggcatcacgaccgccgtaaatttgaagaacgcgcgatatatgcgtatcgacaacgttgttcccggcgaaattgttacattcggcgcggatcaatggaaatgctatccgcactaccgcaaagacgcgaccgctcgaaatggctttggatgggcgagcggtgcgcagcatagcggaacaatgggcttcgcaattcgatataccgggacttaaacaaatggcggcacgaatcgggacgttcattccttcgcttggcttcgaatacggttcggaaaatccaaacatttccgtcgaagtaaacgaattcacgccagcggaatacgcgccgaccgtttacgatccgcgcgacttgttcatgcgcggcggacggtcggcgtatcgcattgcgccttcgaatcgctggcctattgtgggcaaggaaatgcccaacttcttccgcgatttttactttcgaattcacgtacagccgttgcgactggatttgcaaacggttgcatcgtcgcaaacgcgcgaagtgacagtatggaacgcatatccgtacaccttcgcgcagttgaacgacattcttgtttcgaatccgcttggcattgaaattagcggccaatcgacgccgtatacgatgccgccgcttaaagaattgacttacgatattacaatcggcaccgcagggccgccgaacattaacgtcgaaattcaattcgatttttcgaacgtcgataatccgttgccgattttggttacgggtacgcgcgccgtaaagttcgacattatccccgaaacgccggtaacggaagaatgggaatggttgacgaacaacattaccgcagttgacggaaccgaacagcgcatcgcgttgcgcggcgaacttccgcgcgtaactgaaaatttgaaagtcattttcgacgatcaatcgaagttgcgcaagttttacgccgatcttatttcgtgcgtcggtcgtctttggattcctgaattccagtacgcgacacgccttacagccgcaagcgcgaccggaacgttccaactgtatttcgatacagcgcaaaccgacgtgcgccccggcgaatacgtgttgattcaaacgccgttgaccgctgcacttgtcgaaatcgccacgcttaacgcttctggcgctaccgtaacttcggcgctgctgttcgacgtgccttcgggttcgttaatcatgcccggttctccggcactgctagacgacgcttcgaagctgtcgcgctatgccgtgaacgaagtgggcgaaacgacgctaaacgccaagatgattcgccagcggacgcagctacagcggcccggatcaactgtcgtacttccgacgttccttggcgaacctgtcatggacaagcgcccgcttgccgatgaattggtagacgacgccgtatataccggccaacagtctatcgacaattcaaccggacttcccgacattatttcgcgttgggactatagccgcatcggcggcccgcgtagcttcaaagtcaatcgcattaagcggcccgaagaaatggactattggaaggccgtacttgcattcgcacgcggcgcagtgcgcaaattttggatgcccacatatcgaccggacatgcgcgttattgtccagccgtccgacgcatccgcaacgttcacgattgaaggcgtcgaatacgcggaaaaggtgtttccgattaagacgcatcgttatatcgaagttgaaacagcgggcggtattcatcgaactagcgtcacgggcgctactgccgtttcgggttcaacaattatcgtattcaatccgccgcttccgaccggcgcagcatatacggacattaagcgcgtttcgtatctgctacctgttcgacttggcgaagataaggtaacatggaagcattacggcctagaaagccttttgcaactttcgatagttacggcggaaccttaaatgtccgattatgacgacaaagaactaagcgtagacgatagcgccccgttcgaactttacgaatgggtcggcacttatcgtaactactacatgacaagcgacagtattccgcatgtcttcaacagccaaacgtacaaccccgttcccggtttgaagcgtagtacgctgaaagccggaacgcacgaagaagacaatatcgaccttacggttacgcttccgattaccgaacaaatcgtaaaagactacggttttcaaactacgccgcccgcgctggatttgacgatttatcgtttccagcgcgacgccgctacgtatgttccgtattggaaagggccggtcgcttcaatcgtgattaacggcgaagacgcgacgattcgcacgccaagcaagttcggcaatatcctgcaaggcaacataccgaacgtttacgttcaaccgccttgcaataacgttctgttcgatgaacgttgcaaggtaagccgtgcggcgaattcggtaagtaccgtcgtttccatcgttgacggcgtaaatattaccattgcgtcgattggttcgttcccgaacggatggtttgtcggcggcgaaattgcgattcctgcgcgcaacgaacggcgaatgatcgtcgcgcaatccggccagcttttgacagtcaattatgcgttttcgcgtattgctgtcggaacgtctgtcgaagttacggcgggctgcgatcatagttacataagcgcgaacggttgtccgaagttcggcaatcaaattaacttcggcggatgcccgtttgttccgggcgaatcgaataacccatttacgaacggaattagctaatatgtgggtcgcaatcgttatcgcggtaatcgcgttgcttatggtcgcgtttatgccgaaaccgaacgtcgaaaacgcgcgggcggcgaagcttggcgacttccaagttccccggtcgaaatacggcgatcctatgcccctagtgtggggaactgttcgccagaagtcgccgattacgttttggttcggtgacttccgcccggttccgattaagaagaaagtttcttcgggtttattcagttcgaagaaggttattacgggttataaaaactacgtcggtatcgactgctgtttgtgccttgggccgggcgtcgtacttcgtaagttttgggccggtacgtatcttgtttggactggcaccgcgaccggcattacgaatatcgtaatcaatcaaccgaatttgtttggcggcgacgatcaacgcggcggcctgcaaggtacgttcacgttctacgatggccgttacgatccgccgcgcgattcgtacttggcttcggttcttgatccgaacgttccggcgtataacggttttgcgcgcgccctgttcaagtcgttttatatcggcacgacgactaatcttgaaatgttcagcttcgaaatttcgcgtatgacttccggtcttcacgcgacatattcgattatgccgaacggtcttgatttgaacccgatggaaattgcgtatgacgctattacgcagaagttcggacgtttcggcaacttgccttcggttttggacttgccttcgttcatagcgtgcgcgcaaacgctgtataacgaacaaatgggcatgtctatggccgcgcaatcggccattacaggcaaagacctgttagaagaaatcatgcggcaatgcgacggcttgctgtatcaagatccggcaacttcaaagattgttgcgaagcttattcggcaagactacgacgttaatacgttgccggttcttgacgaatccattatcaaagaattgaagaacttttcgaaaacgacttgggacagtacgtttaatcaatgtcgcgttacgttcaaagatcgcgcaggcgattacgacgacagcgtagccattgcccaagacttcgcaaatatcaactatcaacagcgcgtaaaatctaccgaaatttcttcgcccggttgcacgactgccgatgttgcgaacaagcttgcagcgcgtcaactttcgttgattagtgttccgctttataagtgcgacattacttgcaaccgcaaggcttcgacgcttcgtccgggtgacgtgttcgttctgaattgggggccgttcaacctgcaaaaaatggtcatgcggatttcgaaaattgaccttggcgaacttacttcgaacgaagttaagatttcttgcgttcaagaccgattcgctacggcgacgccgacgtttgcgcccccggatggttccggctggacgccaattagcacggctgcaaatccggttacagtgcgaaacttgttcacgccgccgcacttcttggcgcgtctggcaccgaacgaagccctttcgacgttcgacagtcaaggccgattgtacgtcttggctaaggggccgtcgtcggcgtctatttcgttcgatacgatgttcagcggcgacaacttcgctaccgatcccacattagccattgaagcggccccgtataacggcggcggcacgctgtcggctgcatatgccgataccgtggcttttgcgacgcgccaagacacgtcgggcgtgttcaaagtgcaaggcgtgtcttcggcggacattgcgaacttgcagcaatatacgacacttgaccaagcgcgcgacggttccgcgttgcttatggtcaataacgaactgttcgtttatgtcggcttcgttgataacggcgacggttccgttactttcccgaacctatatcgcggcgttctggacaccgtaccggcaagccatgcggcaggcgaccgcgtttggttcgttggcggcatcgacggtttgattccgcagcttgtgaacaacagtgcgacaggttacgttaagctgttggatacgacgacttcggacaagttgccgctgtcgtccgccccgaccgtatccgccgcgcagaatggccgcgcacgcctgccgtatcagccgcagaaccttacccttgacggtagccgtacccctgccccggccacgggcgcaacgtcgatcacggcggcatgggcacgccgcagccgcgaagcgcaagccctgtccgtcttcaacgacgccgacgccgggctagaaaccgggacgcaaacgcgcgtgcggtggcgcgtcggcggtggcggatatactacggtcatggtttccggcacttcgacgacgcttaacgtaaccggccttgtcggtacgttggaagttatcgtagatacgcaaatcacggcaagcgggctgttcagtacgaacagcgaacgcttgaccatgacgctatcttaaaagaacgcaagttcgccgttcttggctttcttcaaacgtccgcagtcgtacagcatttcgaccgcttcgtttatgtaccagtcgtaatttatatcgtcgggaaattcggtcggcaagtccattacaggacgcgcgccgtccgttttcccgactttgtttccgctggcaacgtaagcgatatgcccggcttcgttcttcgggtaataccagcgaacgaccttgcccaagaaacgcccgttcttttcgccgccgccgtgaacgttcttcacgcatacgaagcgccggaagtcgcggcattccttgatcgtcttttctactggcgttccttcgacaagaaaccgaataaccgcgtccgaacataccaaagcttcggggttcttcgacaggatggaattaagcgcggaaccgcgttcgcaataagcgcccttcgtcttcgcgcctagtttttcatccaagaagcgcgcttcgttgtcgccgccgtcttctttgattgcgacatagctattcacgtcgcgcgaatatacggccttgtatcgcgtttcttcggtcttgtatcccgtatgcgcttcccatgctgcaatcaagttgcggacttcttcatgccgcgacttgtgatatttcgaaatgaagccgtccgtattgccggaaatgacttcgacgccgattccttcgattgcttcgataagcataagcaatacaagctgtccggtaatcgtcacttgcaacataagttgcggtgcgtacagcgttgaatatttgttgccaagtttgccgaagcttccgttaatcgtaatcttcaagctgtcggcaattactttccatttcttcgcgcccttgcggtcgccttctttcttgcacttcgccgccattgccttagcgtgaattcgcgtttcgacgatcttgttataaaccgtcaagaacgcttcgcccaagtgcggcgggaacagcttttgattaagaatcgtgcgcggatagaacgattctacgtcgttatccgctagaataatgtcttcggttgcgacatgcgcggtcttcttttctgtcgaatgaaggccgcccattccaagtttgtacgtcgatttgccgatagttactttcagcttttcaatttcggtcggcatgatgggcgaacccaagccgtccagataaaacgccgcgccgcgcacgacttctagcatttgctgtaactgcggcgtctggaaacaaacgaagtccggtacgttgtaatacaacgggccgtcgtctgttagtgtgggcttcttcggatagtaacccaacaccttttcaagttctttattgattaccgcttcggctacctgcgcatcggatttcgaccgaagttctacgccgtattcttccgacatttcggcccgcaacttcaattcgggcgcaagttcgttaaacagaagttcggtattcgcaaggtcgttgcagcaatacgggcgaacgattgcggcatcttcgcgcgtcaatacgtgcgtttcgggaaatggcaagtcctgcatacgttcgcaatgtagccgaccggcgtacagcttcaacgatgccgggcgcgcagtaacgccgccgttcaccgggcaaacgttgaacaagtcgatatggttgtagcggccaatttgtacgccgtacttcttttcgaagtcgaacggcgtaaccttcttcgtaccgtaggccgggccgcttttaatgatgaagtccgaagcttctttaagcttggcgcacgacgcaccacgggccgcaagttcgatcatgggcaagtcatacgatgcgctgttgaagcccacaatacagaatcgccaaagcatccaaagaagcttcgtcgggttaaagtcatggtcgggcgaacgttcaaacgcgacgaactttccggtatcaagcgacttaaacgcgacataccaaaagttgatatacgtttcaacgtcaaagacgaagacgcttccagcgggaagcgccattagttcttcgtccgacatgaattcgacaggccgcaaagcatggcgaatgcttgcggccaacttatcgacgacgcggcttttcttggcaacgatgaagccttgttcgttcaacatatgacagccccttagaacggtatatcgtccgaatacggatcatccgaagttcggttaatgtacgtatcttccgactgttcagtatacgacgcttcggttccaaggtcaagccccataactgcgccgcgcacgttgtcgccgtagaaaattactttgttcgtttcggcgtcgaaatgcgctttcttgaatgcgtgttcgacggaaagcaaaagctttgcactgaaccccattcgttccggcaagccttcgatacgatacgtcgaagcttcttctttgtgcatacgcgacaataccgcgccatcttcgaagaagacatggccgttcggactgaacgattcgatagcacgaacgccccggtaaaagtcttcggggatcggccaaaggttcagattcggaacgtccagaaccgaagcgtaattcgggtaacgttcgccgtaaagctgcgacttgataaacgaaccgtcttcgaaatagaacgtcgccgacgactgcgagtagccgaacccggtaagcgccttcgacgccttcgcaatggccgacgctgcggccttcggaagcataaggccgggcggaaggtcgatgccgtgccacgcttccagcagggccgccccgttcgtcgctacggcgcttccagcttgcagcaggacggcggcataggtcgcattcggcgcgccgtccgttgccagccctgcgaccgcagccaaggccgctttaacccggtcgtcgatcacggcgcattgcggatcgggcggcatgatgggcacttcgtcgaacgctacgcacggcacaagcgcccggaatacgccggacgatacggcaagcgtgttcgccgtaagttgcgtaatcgacagttcgtcaccagccttcgacagtgcgtcgataaactgcaatgtatgcggacacgcggtcaagtcttcttcaattggcgcggccacggtcaagacgccatcgaaggccgccgcccaattgtgggcaatgtgacagaactggatatttaccggcccggctttcttctgcgcaaccgaaataaacttcaatgctgcgataagcgaagcggcggggttcgccgtcttcttcgctgtcgtgccttcggcttgcttgcgggcgcggcttttgcgcttcggcttttccggcgttgcaggaatcggaacgtcgttttcaatttgcgttgtcatagtttcaccattcagcggaaagaacttcgggatacttcttgttcacccaaacgcgaagccttgcgggcgttcgaagttcggatacacgttgcaaagcttgatacgtcgtcggcggcggttcttcgcggtgccgctgtcgccaccagtcccgcgaacgtttcgccgcaagtccggggtgttcaagcatcacaaattcgttaaacatttggaagccgcaaaagtacgatactttaatcattggcggctttgttaaattgccttgtgcgtcgcgtttttcgtgaagattgtatatcaccttttgtacgtcgaaatattcgactatcggggcatcgctgcgcaacggttcggcgacgcccggcgttgcaaacaacttcgtttcgaagctgaattcggcaccgcagttaatacactggcgcgcggcggcatggttgtatacgccgcaaacttcgcaaatacgaaccggcgcgtcgccgccacctttgccggggcgattcggaatacgcgggtcgttgattgggccaagccgacgaatgttcgccgcaaagtcgccgacaagacaattcaccttgccagtttcggggcttgggcgcgtgccgcgtccgtacttctgtacgtgtttgcccggcgatagcgtcgggttcaaatcgccgatgaagtcgattgccggatggtcgaagcctgttgtaagtttctggccggatacgataccgcgaagttcgcccgctttgaatgcgcgcaaacgttcggtattaaccttgtctttcagcttcgaatgcacgggcaatacttccagcccgtaagactgaattacgtttgcgacgtgttcggtattgtcgatgccagttgcgaagacaagccaagtcgaacggttatacgccatttccatcatttcgcggacggcgttaaatactacgtcgtcatcgtctgcggctttttcaagttgtttcgaattaaattcgccgccgactacgccaacgcctgaaatgtcaatttcggttttcgtcgggcgtgcgataagcggcgacaagtaaccttcggcgattaaccgattaaacgattcaacgccggtaatgtcgtaacaaatatcggtgaagattccgttatcggtaatcatgcccattttcatacgatagggcgttgcggtgaatccgataactttaagatgcgggttaattgcgcgcaattcggcgataatgtactgatagaacgaatcttctttgtccgaaagcaaatggcattcgtcaatcaacagcaagtcacgccatccgaaatggcgaagatgcggcgggcgtccgtcgttctgttcaagcgcctttttaatcgccggggctacggactgaacgccgccgaatacgataggcataatcatttcgcggctgttcaagcctgcggaatagatgccaaggggcgcagtcggccagaccgacattagcttttcggcgttctgttcgatcaattctttaacgtgcgtcaacatcattattcgctgattcggccaaagtccgaaaatgcgacgaatgaagttcgcaattacaacagatttgccggttccggtcggcatagcgacgaccgggtttccgacgtttccgcgctggaaatagtcgaagattgaatattcggcttcgtcctgataccagcgcggtacgtagatactagacattttgcgttgtcgccgtgataggtacgtaagacgggcaagcctgcggtacgaagtcgcggggaattacgccgttatgcacgtcgcaaaaccattcgccattttcgaccggacgggccgccttgcaactacgacagttcttttcaggaatcgcgcctttgtggcaaatgtccttcgccgcgcaatacgtgcaatccttgaacgtcggattatcagaaagacgcggcggcggttcctgcgacagaatgatttgttcggccttttcccgcatttgctggcctagccgatgatccaacttcacaagttcgacgtgtaacgaatcgtcgttcttgttaatgttgaagtacagtacgtaacggaatccgtatgccgcgtcgcttccatacgttgaagtttggcaaaaatgctgcggcttcgcaacaggcataccagcttcgccaagcttgttaaagcctgcgccggttccgttcgttttgaattccagcaatacaggttcgtcgattccatagcgcgccggaagctttgcgataccgtcaagcgatccgccgaaatgcccattcaccgccgacacgcgatattgtgggaattccaagccgtccgccttagcgcgtgcgacgtgttgcgtatagtacggatgttccttcgtaatcggtgacgaaaggccgtcgccttcttcgccgggcttcgcaatccaataagaatcgctttcggcgtgatacataaggccgtcgcggttttcgtaccaaacttcggccccgatgccttccagccattcgataaagcgggcttcttcacgatgcccacgattaaacagccgttgcttgcgtccgtccgtctgttcgcggaacgtccagcggaacagataccaaagcttgcgcttgcagccgtcgccgatcaacgacgcgccaaggtgccagcggtggccgccgtcataagtgcgaacgcaatattcgtctatgtcttcaaggatgcgcttagaaagcgccttcgctacgccgggggcgtcaagtgcgacgttttgttttccggcgtcgggcttcgtcgcttgcgcgtcgttcagcgttaattgcgcgttcgtttcgcttttcttgcttgacatcgttcttcacctttcgccggacaagtgcggcgtaattgttcgttaaatagtcggcggaaagcgtcgcaacgtctttaagttgatccttcgataaccaactgatatggcattcggaagcgtctatgccaagttgcgccgcaagccaattgtacgctttcgaccttgacattaagccagtttgccaaagacggtcgaattcgtcatgcgcttttgttcgaagctgtcgcgtagcgcggtcggccatacgaccaagcggaacaaacgtgccgggatgacagccgacagcggcgcgacagtcgttgcagaaataaatatgcggccaatcgccgtaacgacgaccgtaaatccggtcgtttgttgttagttcgatgttgaatgaacaacaggtatcgcattgttcgggtacgggcaatgcgtctttgattttcgacatacttacgcttttccccataaaagaacgccggggccggtgaaagccccggcgatgttacgccgctacgctagttcgccttagcgtgcgccccaaggtgcggcaccgccagccggtgcgccgccctgcggttgctgctgctgccagccgcccggctgtccgccctgcggggccgcgttctgctgcggctgctggccgccccaagctgcgccgttgccctgcggctgctgcggctgctgttggggctgctggccccatgccgcgccgccttgggccggttgctgctgcgcgggctgctgctggccctgcggctggccgccccatgcgccgccctgcgcgggctgttgctgcggctgttgaccgaagccgccttggccctgcggctgctgtccgaagcctgcggcggcctgctgcggctgcgccggggctgcgccctgtccggccttgcccggttcgttgccgttcatgtcgaacacctttttaacttcggtgtactgcgggtcgttcttctgcggcccgacttcgataaggaacgggattccgtgaagctgcgacgaatcgttgatttggaacacgccgataacgtggcagactgcggacaactggcggtgcgcgatttcgaccgtctgttggttcgtatggtacaggttcaggcgatacgcgccggtcgtgccagcctgcgggccgtcgataatccgcaagttcagttgcagataaccgccgtcgttcgccttgttcgccttcacttcggaagtttcgacgataaccggatgcttgccgatgggcaggcttccgacgccttgggtcgggtcgtattgctgcgcgttgaaaggttgaatcagttgcatggtatttaccttttcgaaaagtcttcgccgttggttacggtggcaaagttaccgtttttggctgcgccggtaggattcgaacctacgaatgccggaatcaaaatccggtgccttaccgcttggcgacggcgcaaaagcttattgcatcgctttcgtgaaaagcgccgacaaatcgggcggttcaagttcgcccaagttgcccaaacgatcacgcgcgaacacttcgggaatttctttcgtccgcaacgcccgaaccggcttcggctggcccggtacgatagcttcgcccaagtgcaacacgttgtcgaacaggtgcggaacctttacgttaaggtctttgccggggaagaacggtcgcttttgcatgatcggttcgtatacgacttcgccgccctgcaagatggtttgccgtccgttttccatgacgccttgttttgcaatcattacgatatgcttttgcggcatgtaatacaagtcgttgcaaatcttcatcgtgcgttcggacatattgccgtatgccttcatgccgtgtttaaccttcgacagttcttcggccaagatgatttcggcaatgttcgaaatactgtcaatgcccaaggtatcgaagttcgcggcttcgcgcgacttcataaaccattcgaagaattcggtaatcagcggcggggaatacgcttcccatgcgggaacgttcgaaccgcgcatggacaacatgccgggttcagtgaccaacaacacggggcgcggcgcggtgttgataagcggcgtcttgcccgaaccgggcgaaccgaatacgacggactttacgccatagcgtcgggccagttgcgacgccggtttaagctgcgacatttgcattttgtttactccgattaaagcggcattattgacgacgccgacgctttcgctttcccgactgtccgttgcggcactatgcgacgcgatgcgcggcccggactttcgatgccgtcaagaatgccgccttgattgtgggcaaggcggcaagtgcgttacttcttcgccttcggttccttgatttcaagggtcggcgtaccttccgacgtaacgataacgtcgtcaatgatcttgcggaagttgtcgggcagttgcttgtattcggtaagcgaaagttccggcgtccacttaaccaaacgttcggcgatcaattcgccagcctgtccggtcttttcgatcttcgacaacgccttttcaatgcgcgctttgtcggtcttgccttcggcgttctggatgaagccgtagcgaaccggaaccttcatcgtcgctttgtagccgccgccaagttcgacattttcggtcgtgccggacttcgccgggtcgtgcatgaacatcacggccagcttgcgggcttccaattcggcttctttggcgacttcaagcgcggccttcttcgcctgccaatcgaccaacagacggtcgcgttcggcgatatattcggcttcgctgtagttcttgacttcgcccgtttccgggttcgttacctgaatgatattcggggtcatctttgcacctttcttcgttgggccgccgcacgttgcgccggtatgtgcgtaatgtacgacggcccgtttcggttgtcaagccttttgttcaagaatttttcgttcttcgaacaaatcccgattgttcgcgtcgtgttcggtaaacttttgcgggaaccgcttacgaagcttggcgatgttcacggcctgcgcttcgcggaagttcgaaccgatggcgcgaagcaacagcgcatcgtaccaaaagccgtcgccgacttcttcaagcgcgttcacgtcgtcgaatacggcaccttcggcggtcgccgacagggcttccagcagttcgcccgcttcggtcgctttgccgatgatcgcatgaacgatattgacggcgcgcgcgttggcttcgtcggtgccatcggtggcgatccagtcgggcagcttggcaagcgtgccggtgttgtcgccgggggcaggaacgccgcagtcgcggccatagaaaagcgtcttcttgatcgcgtccagcttcaccagtgcggcgacagcttcggcgatggtttcgcggaagtagccaagcgacacgcggtcgccgtgatagctacccgacgcggttacgtgcgcttcttcgatatagtcgaaggtcttttcgggttcgttcattgcttgcacctttcaaagtcgccgggcaccgcgccgcagcgttccgacactgtagcgccgggcgtgttgcctgtcaacaaaattttgtcttgcctgctagaattttgtcgggtatagtgtcgttcatcttgcccacattgaaccggaaacatggtgcgaacatggccgaaattacgaagctgcgggatgaaacccgcgaactgttgttgaaccgcccggcttcgctggctgttggcactattgccgaagctatgggcgtttcgaagtcttggcttaacgccttcgcgcgtggcgacattgaaaaccccggcgtcgtcacgattgaaacgcttaacgtctatttgaagaagtttgcgaagaaggcaaattgataatgtatcaaaacatacctatcgaaatgcggacatatccgcaatgggttatgtggcggtacgaagacacggattcgaagaaacctactaaggttccgtattctgcccgtaccggcgcactcgccagcgttacagacgcgaacacttggggaacatttgacgaatgtttgcacgcgcttaattccggctggtataacggaatcgggttcgtgttgaccgacgccgacccgtattcgtttatcgaccttgacgacacgaaaggcgatcaaacggcgcttgatcgtcaaatcaaaatctacaacgaattcgacagctacgccgaacgttcgccgtccggttcggggctgcatatcattgtaaaaggcgcggttcctgctggccgtcgtcggtcgtttatcgaagtgtattcgtcgcttcgttatatgaccatgacgggcgatgtttaccgtaatgcgcctatcaaagaacaaaacgaactgttgaacattctttggggccaaatggggcaaggttctgtcgccgttgcgcattacgcaggcgtcgccgaagccaaggaaaccgacgaacaggtttataaccgtgccgtcgccgcagccaacggggataagttcgccgaactattcgcgggcaaatgggaaggcatgtacgcttcgcagtccgaagccgacttcgcattggtcgatattatcgcgttttatacgcagaaccgggcgcagattgcccgcatgtttcgactgtccggcttgggccaacgcgacaaggcgaagcgtgacgattacgtgtcgtacatgctgaacaaatgttttgaccgcatgttgccgcccgtcgatattgacggactgaaaaacaagcttgacgaagcaatagccgcaaaagaagcccgcgaccgtgccgaagccgcatcgttgaataccaacgttccccaagcgccaatcgtcgcgccatccattcccgaaacgtcgaaggtgtattcagtgccgcccggacttgtcggcgaaatcgcccaatacatttacgcacaagcgccgcgcccggttcccgaaatcgcgttggctggcgcgcttggtcttgtcgctggcatcgtaggtcgtgcgtacaatatcagcggcaccggccttaatcagtacgtattgctgttggccccgaccggaacaggtaaagaagccatcgcatccggcattgataagctaatggcgcaagtaatccgcactgtaccggctgcaagcgacttcatcggccccggcgaaatcgcatcggcgcaagcgatcattaagtatatgtcgaaggggccaacgtcgttcgtatcgttggtcggcgaatttggcatctatcttcaacaaatggcaagcttgaacgcgccgccgcatcttttggggctgcgccgtttcatgctggacgcttacaacaaatccggcgaaggtaaggttcttcgtccgtctatctattcggacaaggacaagaacactaccgcagttcttgcgccgtcgttttcgttgcttggcgaatcaacgcccgaaaagttttacgaaggtttgcacgaaggtttgattaccgaaggtcttttgccgcgctttacgatgattgaatatcatggtcaagtgccgccgttgaacaaggccggggcgcgcgtgcaaccgtcgttcgaacttatcgaccgcctttcgacgctttgcgcgcattcgcttatgctgaacagccaacataaagcgatccatgttcaattcgccgaaggcgtcgaacaagcttccgacaagttcgaagaacattgccgcaataacgtaaacagtagcgaccgcgacgttaagcgccaactttggtcgcgcgcccatatgaaggcgttaaagttggccggtatcgtagcagtcggcaataacccatacgaccccgttattacgtcggacgttctgtcatgggcaaccggcgtaatcgttgcagacgtgcgcaacttgcttgcacgcttcgacgctggcgaaattggcgtagacaacgacgaaacgaaacagcttgcgaaggtaattgcgacggttaaagatttcgtcgtatcgccttggccggaagttgcgaagtatgcaggcgaaggcgcaagcaacttgcattcgaaccgcattgttccgtacagctacgtacagcgtcggcttgccgccgtgtcggttttccgtaaagatcgcatcggcgcgtctggcgcaatcaagcgcgcattgaagacgctatgcgaacggggcgacctgcaagaagtgtcgcgggctacgctgtcgaaggactacggaacgtccgccgtcgcgtacatgatcgcgcatccgggcgtcttcggcctgtagcgggccgggatagtgtgggcagaactggccgccttcgggcggctttttcatgcctgaacgaaagttgaacgtatttcccgacgaacggtcgaaaagttgttgacgaagcttcgaagtcggcatagtattcaacccatcgaagcaacgaaccgaacgaaggagtaacgaacatgaacaatcaagaaacatttttcgaagaactggaacgtatcggcgaaatccgccaaggcaatgcgattcttaccaaagaccgcgaaggcttccatttccgcaacgcccgcaatctgttttcgaagttccgccacgacttgccagccgacgccagcgccgaacgtgtcgaagcgcattggaatggctttgtcgccaacatgcgcgcagcgaacgcagcttaacccgtaggccagccccggcccttggcgcacgctaggggccgcgcagcctgcccacaatgaccgaaggtgccagctatggaaatccgcatagacaacgtgaacgaagttctagccgcaatcggcttgaccggacagcacgaacgcaagggccaaggctggcaccgcgtttacattcacgccccgcaagaaggaaccgacgtaacgttgtaccttggccgcgtcatgtttcaacatggcgtattccaatgggtgaaatggtgcgtaccgccgaacgaaggcgaattgcaggattacgacgtatattggttccgttgggccgtatacaccgcaaccggcaagcatctagggccgaagtcttgggcgcggttgaaggccaaggcgcaggaacgcgcgcaggccaagcgcgacgccgccaaggccgcacgggacgccctgaacgccgacagggtagccgcaggcaagaagccccggacgcgcgcccttgcgcccgtgaacccgcgccgggcggcgtgcatgatcgtcggcgaatggctgtccgccgaacttggccgcgaagtacatttgttcgcattctaacgaaggagttatcgcaatgaaatacgtaatgttcaagaaggtacacaaggaattgacgcagtatgtaccgattgtttttccgaacatcatagttcacgccgacatggcaaaggcgatgcttgccgggccgctggcgggcttcgtcgttcatagcgccggggaagtttcgccgctggatatgaagccgcacggtgaaagttcgacgctgaacgtaaaagcggacttgcccgacgatgaacgccgattgttaatgaatgactacggcgcaatgtatgaatgattcgacaaatcgaccgcttcggcggtctttttgtttgtacgcatataatagacgacgatccgtttaacggtgccgtataacacgcaaagccttgatacgcctagctttcagggcatttataacaagtataacggtataacgccccggcaccgaatcccccgccctattgataaatagtcactttcaataaatagctatattttaggtattatacttattatattttttatattttctttaatttcaatgacttagaagctatacagcccattcaatccgtataacgggtgactttcaataaaaagcttgacaattgataaaaggccgggtacgctagggctgtttataaattggagtgcgaaccatgacagaagctaagaagtacgacgtaatcgacgcatcaccgaaggcgctatcgcattgcgtcgccgaagaagtgaagcaaggcgaacgcgacgtaagcgaagcgaacgcgaagtatccgtttaagtcgctgcgcgtaggcgaatccttcgcaattccgttcgacgacatggggccgggcacgctgcaaagcgtccgcagttcggccagcctgaacggcaagaagcttcaacgtaaattcaagatcattacgcacgacgattaccgttgcgtcgaagtcgcgcggatcaagtaagccgggccaatgtgggcaacaaccgaaggggcgatcaatgtacgaaatacagaacgggcacaagatgccgaaggcgcgtcgcaaggctggaagcgaaccgccagcggtgaagaccgcatttaacgaatacgcggacgcatacaaagctgtttacggcgtgcgtccgctgtcgtatacttacgacgtagcgacgaagtttattcgcatcgaaaacagcggcggcgtaagcctgtcgcgtttgcgcgaaatgacgaagcaacttcgttaccgtaaaggttgacagcttcgaagtttcatcgtagtatgaccatgcgaaccgggcgcttcccggcaattgaaaggagttaacgaaatgtgcatcgtttgtgacattaagcgcatgaacccgtcgcccgaagttatggcgaaggtcgaagaactggcgcgcggtctggataccgctttgaccgtggcgcaagaagtcgccgaagcgaaccccggcgcgttcaacgatgaacagcgcgaccgtatgcagtccgccgccgacctgctgaatcagcgcgaaggcggcatcggcgggcttgccgcgatccttgcggccatccttggcggtgcgcgtgttgaagttgcgcacgttgaattgcgcgacggcgaaagccccgaagatgccgtagaacgctacatggccgaaaagaaggccgaagcgtcgaagaacgaaactaagcattgaccgaaagccccggctagtgtatagtcggggcttcttcgtaggggaacgaaaccaacatggccgacgaaatagacgcaacagccgaccgcatggacaacgaactagcgttgaccatcgctaacacttgccgcattgccgccgcgattccgaaaggctatcccggcgaatgcttcttttgtggcgaagacttcgcccgcgttgtcgaagtgaccgacccgcgcagcggcgaacgtgtcgattcctgcgggcgctgtcgtgacgcaaggggcataaaatgacaccgaacaaactagcgaaagaatccgaacattcgcaacaggtcgcattgttcgcatacgtagctgtcgcacgaatatacggatttgatattgccgacgaatggtgcaaaactggtaaactgccgaaatacgacgtatcgccggaaggtttgccgcgcgatatgcaagacgacgaaatagaacgtttcggtcgcgtcgtaacttggtctaaagccgtacctgcgcttgaatggttccacgcgatcccgaacggcggtagccgtggcgacgacgaaaagtcgcgcaagatacgcggcggccagatgaaggccgaaggcgtgcgacagggcgtagccgatacgttcttgccttggccggtctacgaacaaagcccgaccgattcgcaacaaatggtcgtaaaatggtgcggcctttatatcgaaatgaagaagccttcgcttcgtccgaagtcggaaacggcgaagggcggcgcatcggacgaacaaatagccttcggccagtacgcgcagcgcgtcggctatgggtgggccgtgtgctatgattgggaacaggccgttagctaccttcgtagctatatcgaatggggttcgaaatgaacgacaaaccgataaccgaaaagttccgcgacttcgtgaaagaagacgggccgcgcatcttcgaagaaatcaaggccaatcgggcgaagttggaagcgtgcccgaaacatcatttcaacatcggcgacccgccgtataagttcggtgcgaagttcacttgcacgaactgcggcggcacaatggacgcggtacaggcgttccgctactgccaaggctacgaagcggcgggcggcgacccgaacgaagttatcgaaggcttccgctaatggattgcctgaaatgcgaactaacccgcgcgaagcttaaaacggctggcctgctaattgtgggctggccgttgtcgcgtatagctgaacacctttccgactgctacggcgaacggtactacgtcgaaggcgacaagctataccgggcgtcgaagcttccgccgtatgaaccgcacttgataaggagtaacgaaaatgacacttgacgaagccaagaagaaggcacgcgaaaaccgttgcttcatcgtaacgaaacctgaatactttttgctttaccgtgaatcaacgccgaagaacgtatgcgtcggcaaacggaaggacgaaaaaggcatcatcgcgctagtgaaaaaagcttgcgcgaccgcttgacgtagcttcgaaaccgtcgtagactatgcccatagtcaacgaacaaggggcacgaaatgggcgcatacaccgtaacaactgaattcgaaatgaacgacggtcgcattctgtcgtgcgaatacggcgtatcgttcacgccgggcaactattcaggtctgcccgaaaactgctaccccgacgaaagcgaagcgggcgaaccgacgtattatatcgacggcgaagaagtcgattacaaggacttgccgaaaggtcttgacaagatcgccgacaagttgtacgaagccgggccgggcgaatacggctacagcgaaaccgaaccggactacgacggcccggactacgaacccgacgactattattgaaggagtaaccgcaatgcctacccttgccgaactgttttggcacttcgtcacgctttccagcggcgtaaccatcggcctaatgctggccgcatggttgcgtatgcaatcgaaagtcaccgaagaaacctacgacaccgattgcgaattcgtaaccgaatatatcgccaacatggaaagcggcccgaagatcattcgtcgcccgctgtcgcaatggccgatatgggcggacagcattaacccggccaagacgaacccgcccgaacctgaaccgccgattcgcattgaacgaaattttatcggcaaaaaggattgacaggctttcgaagctgtcgtattctttgtcgtaccaactggcaaccaaaaaggaatcgccgccatgtacgcacttattcttatcgcttgcactgtcgttgctgtcgctattcacttcgggcttatccgtcccgtaatgcacgccatcgaacgccagcgcgaagaatcgcggcgtcgtgcggcgcttgaagctggcttggccgctgcggcgcgcttgcaggcgtttaacgcccgtaagccgtcgaaccatcgcggcgcaaagctgaacgccgaacgcgaatggcggttgcaggaatgaagcgcgggcacgtcatttacacgcacccggacgaactgtcgaaatgggatcgcaggtttatcgaactggcggaacaagtcgcgtcatggtcgaaggggccgcgcaagcgcataggcgcggccatcgtacggcctgataggtctatcgcgtcgcttggctacaatggcccgccgcgcggcttcgatgatgaagccttcttgcgcatgatgcgcgaagaacaacacgccgtcgtaattcacgccgaagcgaacgccattgcgcaggcgcacgacggcgaagccttggccggttacacgctgtacgtgtcgccgctgttcccgtgcgccgtctgcgcccgtcgcatcgttgacgcaggcattcggcgcgttgtcgcctattgtgggcacatttccccggactggcgcgcgtctgccgatgaagccgaagaagtcttcatagctgcgggcgtcgaatgtctgtttagcatggattaacgaatatgacgcttgaccattcgcaaatcgaagggctgttgttcttcgaagaccccgtaacgcataacgtaatcggcgcagctaaggccgcaccgctggacttgtccggccatttcgtcgcattcgggccgcgcattacagttgatccgctgttgaagaacttgtttcttgccgcgccgacgttgtatcaaacgctgtcgcagcagtaccaagcgattcaaggtcttatcgaaatcgccgaaggcttgccgcaaacgccggaacttgataagctgcaacggtcgtttgtcgaaatgcaaaacggcatgttaatggcgcagcttgtcgcacaaaaaggcatcgaagaagttgcgaattcgcttgacaagccgccgaagtagtcgtagactgtcaaatatcgaaacaacgaaccaaggtgcccacaatgaagcgtaatgttaaagtcctgttggcgattgccgccattgttgccgctttcggcgtcgttggttcgatggattaccgcgacgaagtgcgcgaacagctttcatattgtgagaatgtgaagaacggcgtatggccggacttcaaggaatggggcaaaactgaatgcagccccgaacgcatcgcagaacttaaaaatattttgcgttgatcgcttgacacgtcgaacgaacagcgtaaaattacccctgtcgcaataacgcgacgttaactttccttcgaaggagtttcaaaaatggctaagcccaagaagtccaccgctaccgccgccgcttccgccgctgtcgtgatcggtcttgctgaaatcgttgcagccggtgcaaacgggctgtatactacccccgaagttcacggcccgcttgtcgaacagggcttggtcgaactgaaccccgccgggccgaacgaagccggcgaaactctcactcgcgccacgcagaaaggtatcgaatccatgaacaccgcaaccaacaccgccccggccaccgtcgccgctgctgccccgtcgtccttcgccatcgaagacggcatcgccatgccgaccgcttccggtcgcggtcgtggcggcaacgtgtaccccttcgacgccctgaacgtcggccaatcgttcttcgtcccgaacaccgaagacaagccgaacgccgccaagtcgctggcttcgaccgtttccagcgcgaccgcgcgttacgccgaagtcgtcgaaggccagttcaagacgaacaagaagggcgaacaggtgcccgtgacccgcgaaacccgcaagttcgttgttcgcagcgtcgaaggcggcgcgcgcgtctggcgtaccgcctaagcgccccggcgtgcggcctacgggccgcgctacggccagaacgaagccccggcactgtccggggcttctttttgcctttctgctggcctacggccattttttcgggtactatcgggacaattcggggcgcagttcgccccttgcgcgtattaaggggctacgtagtgccattgaacaacgaagcggggcaggatatgaacgaacgtccgcagaagatcatagacgcaaaattgccgttaccttggcttatcggttcggcttgcgccgtagtcttttcaatgggcggcgtattcgtcaaactggacgccgtaggcgcatcgcttacgaagctggaagcgaagaccgacacgcgcgacgaacgaatttcaacgcttgcgcaatcgttgatacagcaggccggaaagaacgatacgcaggacgcgcaaattacccgcaacgccgcagacattaccgacttgaaacgcgacgttgaagacatacgcaagtcgcaacgttggatgccgaagtaatgaaaaagaaagtcgaactaatcgaagattggcgcaccgcccataagctttggtcggttcgactgtcggccatcggtgccgccgtaatgggcgtgtttaccgtatggcccgaatccgcgttgtatctttggtcggccatgccgtccgaagtgcgcgcgttgatccccgaacggttcgtatccggcatcgcgcttttcgtattcaccatgtccgcactgtcgcggatcgtcaagcaaaggccgaagaatgaacgaatcgaacgaaagcccgcagaagaaacagccgaataaaaagacgcttgcgggcgtccttggcgcaggtgccgccgcaatcctgctaggcgtagccgggcaaaccggctttaccgaacgcttcgaaggcatggttcttcgcggctaccttgaccctatcggcgttccgacgaagtgcgcaggcgatacatacggcgtcgaagtcggcaagcgatacaccatcgaagaatgccgcgaatcgctggaacagggtttgattaaacacgccgaacccgtgttgaagtgcgcgccgaacctgcgaacgcaaggctaccccttcgcactggccgccgcagtcgatcataactaccatttcggcacgttctgcggaacttcaatcgacgcagcgtttaagcgcggcgactatcgtacaggctgcgcacgcttcaacgaaaacgccgcaggccgcccgcaatgggtgtacgtcaaggacggcaagggcggttacaagacccttcccggccttatcacgcgggccgcagcgcgccgcgaactttgcatgaaaggggccggataatgtgggctatcatcgtagcgggcgcaaagcgtttcggcggctggattctggccgcattgtcgtttctggcgatgctggcgacaatttggcttacgtcccgaaaagtcggtaagtccgaagggcaagccgaagcggcggaacagcgcgcagccgaccgcgaagctatcgcagtacgcgaagttaacgaagcgcgcgaagcttccgaacgtcaaacaaaggcggtgcaaaatgcgaacgaagttgcttccgataatgctgttcttgacgatgacggcgtttctaagcggctgcgcgacgaatggtcgcgcgactaagccgccgcaatccatcgccgaaaccgtgcaaacgaagcccgtagtaatcgacacggcttgcgattgggtgcgggcgatttgggtttcgaagtcggacgacataacgcccggcacggcgcgccaaatcctgaaccataatcaagccgtcgtaaagaactgcgggccgcagaaaccgcccaaggtcgattcgccttaacagaacgtcggccttgcggtatagtgaaggcaaatgcgaatgacaggccgacgccatgaccgaccaacgtaacgaatccgaagaaaaggccgcatatgcggccttgcttttgaaggaacgcgaccccttcaaggctgcgcttcaactgttccccgacaacacgaatcgcgccctatgggtggcgaatcattggccgattgacgccgaagtaaaggccgaacaagaacggttaatgggcgaagacgacggttcgtcgttccttccgtcgaaggccgaacttgcccgcgacatttggcaacgtatgcagggcacgacccttgcaaacggcgtgaccattccgccgacccccgaagaatacgcgaagcttgcgaagctttacgcggacgttcgcgggttcatcgaaaagccgcaaacgaatgtgaacgtaacgacgaacgtacagcgtgtcgtcgaagttcccgttttccaaagcgaaagcgaatgggaaaacgccgccgcacgtcaacagcgggaattgttagaaaatgcccgcactcgccattaaagcgcccgaagcgccgccgctgattctacagaaagcgccgccaatcgaagtcgtatttaagccgcttcccggttcgcagactatcgcgctttgttcgcacgctgcgcataccctgtacgaaggcgcacgcggccccggcaaaactctaacgcagttaatgcgttattaccgtaacgtcggcaaaggttacggtaagttttggcgcggcgttatcttcgatcttgaattcgaccatttggccggacttgtcgccgaatctaaaaaatggttcggcgacaatggtaagttgaaagatggggcgaagttcttagaatcgccgtcccaatacaaatgggtttggccgactggcgaagaactgttgtttcgccacgtaaaaaaggtcgccg

SEQ ID NO: 17 - DNA, 40570 bp, unidentified
  misc_feature 1..11: note = bacteriophages nucleic acid sequence
  source 1..40570: mol_type = genomic DNA
cgcaatatcgggctgtcagtccaactcgcagatgcgaccgtccggtgcgtcacaagcgacggtagacccctccctgatggtcgagccgaactacgaagcgactttgcttcagctcttatcgagcaagcccaacgagcagacgcccaagtgaagggccttcagaaaaccgtaagagcactgcaaggaggtaagtaatgtcgaaaccccgcaatggggccgacgatctggagctgattaaaaggtcattcgtggcctttctttttgtcctgtggagggcactgaacctacccaaaccgactaaatgccagatcgacatggccaagaaactgagcgccggtgacgagcgccgttttattcttcaagcattccgaggtatcgggaagtccttcatcacctgcgccttcgtggtgtggaagctgtggaacaacccagacctcaaatttatgatcgtgtccgcttccaaggaacgggcagacgccaacagcgtgttcatcaagcgcatcatcgaccttctcccattccttcacgagctgaagccggggccgggtcaacgtgacagctctctcgccttcgacgtgggtcctgccaaacccgaccactcaccctctgtgaagtctgtaggtatcaccggtcagttgactggtagccgtgctgacatcctcattgcggacgacgttgaggttcccaacaactctgccactcagaccgcccgagatcacctcggagagctggtgaaggagttcgatgcgatcctgaagccgggtggtacgatcatctatctgggcacccctcagaccgagatgacactctaccgcgagctggaaggccgtggatacgtcacaacgatctggcctgcgagataccctaaagaccaagctgactgggactcctacggcccacggctggctcctatgctggctgctgagctacaggcagatggttccctgttctgggcaccgactgacgaggttcgcttcgatgacaaggacctgcgtgagcgggaactgtcctacggcaagggtggcttcgcacttcagttcatgctcaacccgaacctctccgacatggagaagtaccctctcaagctgcgtgacttcatcgtagggacgtttgctcaggacaagggaccaaccaccctcatctggatgccaaacgcttccaacgagtgcaagggcgttcctgtggtgggtctcaaaggtgaccgcttccaccgctacgaatccgttggtcaagccactgcgagctacgctcagaaaatccttgtgatcgacccctcgggccgtggtaaggatgagaccggctacgctgtgctgtaccaactcaacggctacatcttcctgatggacgctggtggtttccgtggtggctacgaggacactgttctccaagctctggccaacatcgccaagattcacaaggtcaatgagatcgtcgttgagggcaacttcggtgatggtatgtacatcaagctgctggcccctgtggtcaccgctacgttcccttgtgcgatcactgaggttaagtccaagggtcagaaggaactgcgcatatgcgacgttctggagcctgtactgggcagccacaagttggtcatccaagagagcctcattgagaaggactaccggacagctcttaacgctgacggcaccactgacacgtcctacagcctcctgtaccagctcactcggatcacccgtgagagagggtcactggctcgcgatgaccgtctcgatgccctcgccattggcgttcagttcttcactgaggcactggagcgggactcgaaggtaggtgagtcggagatgctgcaagagttccttgagagccacatggaggacgccctgatgggtcacgaccggttgctggagatgtcgatcagcgaaggtgtgtcgatccagtacgaggacgatggctcaatgtccaattacatgggctggtaaggactctgcaagatcgcagcaagatcgacgaagatttaaaaaccctcactatggcccagagagggggtttatctcatagataaacttagagactctgcacgatccctacaaggtaggttcttcgtgcagtgcttctccctcgaccaattcaacagtgattatcaacaaaggaggtaaggccatgaccgtggagagagcgactgtgctgctcgtcttaaagcgccttgccctctctcggtccacctacaagctcatcggccttctgctcgtcaccttcggggtggcaagtggtagtgatgttatgggctgggtctccaccatcgtgtgtgtggcctctggcggatgcggtgactgacgctcaatttcggcagggttaacaccctacctcattgagccataagagcaaggcttaacgtttccctaactggtctccataggatgccctttagggtatcgttaggtctacccgatagatggcacttgcatgaaccgttgggttaccataggatgacctttaagaatctgacagaaaaatctgaatggtcacctctcaaggacaacagccgagagttcccccgtaggggcctctcaaggatgatccatagggtgacctccccggtgacctctgagtgagatcgcctcgtttccctcaagggcatctcatggggatcattatgggccagctcagagggatgatccaattgattatctcaatggggactcatggggatcatagggaatctcaatgggcctctatctgtccctatctgtaagtcctccttgagttccctataagtcatccataggcttgacactgagaccatccataggctatcgcgtgtgtgcgctcataaggacccccctcaaagactgtctacctgatgacccataggatcaggatccatagggatggcctatcagctcttaggcaacgatagaaactcagttgttgacgacccatgattattcctgtctaatggctcccatcaacggcaaacactgagttgatcgccacggtctctggccttggtcctaacggtctcactgagatgaccatagggatcgacaccagagcctataagggccacaagctgggtcgggcaatacttcgagttaccctaaagcatgtgagtagcaacaagggctgaaacaaacgcttgacaagatggtgaaacgctgtagaatggccaccatcaacaacgcaacacggcaacactgagatgctcttacaggtctcgaaagggcaacgaattggctgatagacacggcctaacgggcacccttacgctctttaacaactcggaatgctacaccacgcactgagccggtctcgcctctcagggcaaccataggaggcttgtaggccctcggtgcgtggcagtgataggaaatacagcaagatggtcttgtgtgagccgagcagtagctgggttaccagcagtccacgcaaggagtcagtaacaggaccatcgtctgtatctcccgtaaaccctcactgaaggacgcacgctatgagcattgcaactgacaagctcaaggaccagcttcacgaactggagcagcgcatcaaggtagcgatcaacgaacacgagcaggcaaagagtgccttcggtcgtcttgaagtccctccttcgcatcctatgtggggagtgtttcgggaccgtatcgactccactctggtacaccaaagggtcctgcaagcgctctggcatcgcactaaggctgagctactcgaacgaatgaacgctgacaaggagcctgagtaatggcacaccggaagttctctgagctgtcgaacggtgacactggccgcatcgccaaggtatacaccgatggctgctggggtgagtacatcgtcaagtttcaccatccaaagaccgggtacaacaaggccgctgactatcacaccagcgaccgattggacgcactggacaccgcacaacactggatcagacaacaggactgacatcatggcacgcaaagtaacgcaagacgctgtaaacgcattcatcgctggccgcactggtagcttcggtggtaacaccacggtcgaactctctccactcggtgaggtgatcgttctcaagctccacggcaacgccattgcacgccgcgacaagggaccaatgggcacctttgaggtttgcgacggtggctggtcgagcaacaccaccaaagagcgcctgaacggtctaccgggcgtccgtgtgaaccaaaaggactacgcatggttcctcaatggcgaaccgtggaatggcaactggaccaccatcaatgggtgaccattcactcaagggcgctcgctgagtgtcccttggggaagcaatcacgcacaccacaacgtaccaccaacaatcgaaggtagcaccatgtccaatcgtcaactgcaattcatcctcgctcgtgccgcttgcctgctggtcgaggcttacactaagtgcatcgctgagtaccgcactatcctcccactggatggccgcattggtctggacgcaccgagcaccttcgagggtctcaaagcggacgccgctaaggggttcctcaaggtctccactgagttcaacacgtcgagcatctacggtggctctggcaacctgacgttccgcaccttccatgacttcggtcatctgctgtacaacaaggagttcacactggctgacgaagtggaactgtcgcgcatccaatggcaggacttgaagggctatctccctgccgagtgggtggacgtgtgccactgcgtctatgtcgctgacactgagcagcaatcgctgtacgaagccgagacgggcaacttcccggctgaccagaaacgctttgtcatgggcttccttgccgatcacttcgcttaatcaacctctgagaatcaataggtaaacgctatgcgctacaaccgcaccaacttcgtgtccgctcgtgtcgtaacgagcatcatcgccgccatccaagcggtaatcgcttcgggcatccctcagtacattgaggatcgcaagggccaacgctggctccgtgtggctctcaagatgctggacggcaagcctcaactggaattctttgcccgcaatgggcaggaagtcggggacgtgatcttgcaggcgtctttcgattggcacgctgacgacctcaccgagttctctcagttactggtcaaagtttatacaatgaccgagctgcctaccacacctgcccgaccagtggaacctaaagttgatcccgagcctgccgttaacctgccttccggtctcgtttcgtggcgtctgccttctggcctgaccctgtacggacactggcggcgcaagtggttccgcaagcgcttctatgtgacccacgaccgcaacggccaactgccacaaggtgagggttactacctcgaccccgaagccctgctgtatggcacctgccaaggggtggtcgcatgagccgggtccttgaccatgctgtgaccggtatcgcatcggtggacaagtatcacccgctgctacgtgaacatctcccgtacatcaaggagatggccgaactcgccgagacgcaaggcccaatcactgcggcctgtttctctgagtccagcggtttccaaaagttccttgacgattgcgtggtgtgtcatgcaccgggcgtctactcggtcgcttacctgtcgccacggtactgcgctgagattctcaaggaagtcaagaagtttcctcacacggtcaacgatgaggaacccgaggaagcgcagatacccgaggtggtctttcagaacgagcacccggttctgttcgaggtcttccggtccttctgggcagacgctggtgtgacgctggcaaaggtgctgctcggtctcgaccctgtgaacctgaccacctgccaagccgctcagtacgtccctacgggcatctcaaggggtcactggcacatcgaccaagactctgacgtaacgctcgtggtggccctcaatgacgaccacaagggcggtggcacgatggtctatcggggtcccttcgcacctgctgtcgaggttcctcaaaacgaaacgggctgggcaatgctgttctgcggcaagacgacccagcactacggaatccctgttatcgaaggcgagcgcaacctgctcgtccactggagtgaaatcaagtgatgcacacgaactacaaaccggcccgccgtgggctgctggctgagcagatcgccagtgagaaggaagcggctattgacgccaccatgcgccacccagaggcgaaagcgagcgtgatgactgccatgtatggtggtcgtcgcacactgggcgctaaggctgtcgcagaccgctttggcaacatcgcagcaatccagcaggcaatgggtctgcgctacagcgaccgtggcgacttcacccgctgctaccggggaggcttctgacatgaatcgagtcatgccaccaccgacgaaccgggtcaaggaggtgacctttaaggtctcccgtccagatggtcagtatggcctccacaagctcactgacgcgacgttctcacttggccttggccctcgtgggcgctgggtgcaacgccttgaggtggacgttacagaccatctgctgaggattcgccagcactcaaccgggttcgacatcaccgaggcagcccgtgagaactccgaaagtcgccagctccttgagatgtcatcgggtcgctatccgtggctcaagcgtgacgctctggacgctgcccttcgtgagtaccaccaagagcgtctcaacgtgacccgcgagattctccgcaaggcgaacgatgactacgagatcaaggagtttatctacaagatcgcagacattcatggtcggatcgtaaccaccaagtaacgctggatttaaaaaccctcactgtggctgcacacactatgggggcttttatcttaaagacatctcaaaggtcatcttaaagaccgtccgtgtgggcagctcatcgctaacccattcgagacgattaaatgaccattgcaattcccgaacgtcacgacttcagcgacatcaattcgtctgctgctttcgatgccttgagcaacatctacggtcctgcactcgccgctgagcaactccagctcgaacatgaggcttacaccctcggcgaagaacggttccacaaggcaatggaacggcagatggaacgaggtgagttctccaacagccaagtagcgaaaccgctgctcggtcatctggtcccaatgctgtccaaggccatcacggattggatcgaacaccagaccaccaaggttcgccgcaagcatgtggcccttggggcgttccaacagatgaacccagagacgatggcatccattgtcattcgctggaccatcaaccgtatcgctcaacgctctggcgctccgaccatcactgagatggctgtgagcatcggtggtgcccttgaggaagaagcacggttcggtcgcatccgtgtccttgagcaacagcactaccagaagcacatcaagaaggccctcgcccagcgcaatgggatgacctacaaggtcgcctatatggagaaggtcgaagcccacatgatcgaggcagggcaactcaacgagccttggaccgagtgggaccagtctggcgcagatgtccgctaccacatgggcatccgtatgctggaactgctgatcgaatcgacccagcttatcgaggtcgttcgtgagcacaaaggcaacaagaagctggacggtgagtatgtctacctgaaagcggaatgggccgacaagctccagagccgtgcgtacatcctgtctggggtcttcccgcgctaccagccaatggtcgtgcctccgaagccttggaacggtgtgcgtggtggtggctactgggccaagggtcgcaagcctgtgaccttcatccgtgtcccgacaaagcgagcgctcaaccgctaccgcgatgtccacatgccggaagtctacaaggccgtcaacctcgcacaagcaacaccgtgggcgatcaaccagaaagtcctcgctgtggcaaacgctgtgatgtcttgggagaacgtgccaatcaaagagttcccctcaacggaacgtgaagccctgccgatcaagccgggtgacatcgagaccaacgaggaagccttgaaggcgtggaagaaggcagccgctggggtgtaccgaaaggacgccgcaagggtctctcgccgactctcctatgagttctctcttgagcaggcaaacaagttcgctgagtacgatgcgatctacttcccgtacaacctcgactggcgtggccgggtctatgcgatccctgcgttcaaccctcaatccaacgacatgaccaaaggcatccttcaggctgccaaaggtgagccggtgggcaaggacggtatcgagtggctgatgatccacggtgcgaactgtgccggggtcgataaggttgacttcagccagcgcaagcagtggatcaaggacaacgaggaaatgattcttcgctgtgcccatgacccgctcatcaacaccgactggatggacatggactcacccttctgcttcttggcgttctgcttcgagtggcaaggtgtgaagctccacggggaagcccatgtgtctgccctgccgattgccttcgacggttcttgctcgggcattcagcacttctctgcgatgctccgtgatgagcgtggtggtcgtgctgtgaacctgctcccaagtgatgacgtacaggacatctacaagctggtctcggatgaggttgagatcgcccttcagtgggacttgaagtacggcaccgaggattccacggtactcgacaccaacgaggacaccggggagatcaccgagcgtcgtgtccttggaacaaaaaccctcgctatggcgtggctcacctacgggatgtcccgaaaggtaaccaagcggtctgttatgaccctcgcctacggatcgaaagcctacgggttcgccgatcaggttcgtgaggacatcgtgaagaaggccatcgacaacggtgacggtgagatgttcaccagtccgggcgaagcgagccgctacatggctggcaaaatctgggactctgtgagcgtcgttgtggtcgctgctgtggaagcaatgaactggctccagaaggctgcgaagctgctcgcctctgaggtcaagtgcaagaagaccaagcaggtcctgaagcctgcgatgccggtctactgggtcacgcctgatggcttcccggtctggcaggagtacatgattcccgagacccggcgaatcgacctgatgttccttggcgacgttcgcattcaagcgaccgtgactgtccgagacagcgacaagattgacgcccgcaagcaagagtcgggcatctccccgaacttcgtccactcgcaagatggctcccaccttcgcaagactgtggtccacgctgctgagcggtatggcatcgagttcttcgctctcatccacgactccttcggcaccatccctgcacacgctggggccatgttcaaggcagtccgcgagacgatggtcgagacctacgaaagtaacaacgtccttgaggacttccgtgagcagttcatggatcagctccacgaatcccaactggacaagatgccaccgatccctgagatgggcacgctggacatccgtgaaattctcaaatcccaattcgcattcgcttaacacaaggaaaccaattcatgttcggtcgtaacttcgagaaaaccacccgcaccaacgctcgccgctccttcgaggaaatcgagcaggtccgctccaagaaaggcaagcgcaacaagcaagcccgtggaggtcgtcaggagtggtctgaagaatgaacctgcataacgtccgtcaggttatctgcgagcatccacacaaccagaccatcacggttgaagtgggaacccgtgagagcgccgtaaggatcaccatcgactggtgggacgacaacgcccgcttgatcgtacaggctctggcccgtgaggttcgtgttaatccagacctcatgctgctctaccaatacctcggcgaagaagggcgggtcatccacctgtccctcgacatcgcccaacaaaccatccgctacctgaaggagaccaactaatgcaagtcactatcgccgctaccagttccgtgctggacaacaacatggtcctgatcgagacctcagtgaccatcggtgattctgtcaccaccacccgcgctggctacgacaaacttgagctgctcgacaaccgctatctctcgggcaccttcgaggaacgtgtcgaagccctgcgccagtccgctgagcgtatgaccgagaccagcgtcaagctgcacttccaagcgctcgccaagatcgcctcgccagaagctctggtgaccgacgtggccttctctggggtcggcgtcaaggccactcaggaactcgctgagaaggtcgagcaggcgcttgaagcacccgccaagaagacccgtaagccacgcacccctaaagccgcccagtaaggagcaacccaatgtccaaagtcgaagccgtcatcctgaacaccaagccgttccgcccaaccgactacaacgagaaagccatgcaggccgtgctcgatgagtcgtacctgcaagtggacgtgaagaaggatggcgttcgcctcaacctgtgcgtctctggtcgcgctccactggtcaacgtcgagtggctgtcccgtgagggcaagcgcttcccggctctggtccagtacctgcaaggggacgagcgctggtccaagttctacaacccgcacctcggtgaagccctgttcaatgacgaaggcttcatgctggacgctgagttgatcctgctggacgacgaaggcaatgagaagaagtgcaagaacacctcgggcgatcttcgccggaaggatgagccggtgccaatgaaccgcatccgggtctacgtgttcgacatcgtgcctctggacgtgatcgctgagggcatcgagtacgatgtcatgcagtgtgtccgtaagggccacgttgagtaccaagtcgccaagctcaaggaatacttccccgagatcgactggatcgtcgctgagacctatgaggtctactcgatggaaaccatgccggtcattgagcgcccttcggttgacgaggatggcaacgagatcaccgtgacccttcagccaccgctgagcctgacccacctgtacgccactgtgcgtgagcgtggtgaggaaggtctggcctgcaaggacccgatgggcttctatcgtcgctccaaggtgagcggctggtggaagatggttccagacgacaacgaggatggcgtcattcaggatgtcatctggggcaccaagggtctggccaacgagggcaaggtgatcggcttcaaggtactgctggagtcgggccatgtggtcaacgcctgcaagatcagccgcgcactgatggacgagttcacggacaccgagactcgcctgcccggttactacaagggccacaccgcgaaggtcacgttcatggaacgctaccctgacgggtctctgcgccacccttcgttcgattccttccggggaatctccagcgccaccattaaggagtaactcaacgagcctcatcgacttcggtcggtggggcttttttgtgctcgttacgataggagaaatctatgggatggacctttctgatagtcgtttggaacctgctctggatcgctgctgtttataggtttcgatgaccgaatttaaaaaccctcactttggctgcacacatcgaacaacccaaaggaggttcacatgacccaacctgtactgcttcacagcaacaaaggaactggccacttcaccgtgcgccaagaccgcgagatcgttaaatggctgggcaaggttcccttccatgccgttctcatcaacccggtcggcaccaagttcctcgtcaccaagggcacctttgcgcaatcccgaaagctgggccgcattgtgctcaaaccctacaccggcaagttccctcgctgtgccctcgtctggcagatcgtgaaggaggtcttcgcatgagccgcgtgattatcgctctgacttctgagcgtggtcgctcgggtaaagacaccctcgtcgagctgctccgtgaggaaggcttcgaggtctatcgggtcgccttcggggatgtcctgaagcaccagtgctcgctcgtcctgactgactgccgtgaggctcaggtcgtcatggagagccacatgcacacggacctgaaggatgccaagttcgaggaactctcgatcaacaacatccccgactccgagtacagcgactggctccgtgagaacttctgggacgacaccgcacctcagtcgcctcgctggcatctccagcagtacggcacgggcttccgtcgcaactacaagggcgagcctgacgtgtggcttaacgagggcctcaagctcatcgagaaggccccagaggattccctcgtggtcgtcaccgacatgcgccaagccaacgagtatctggcccttgagggtctcggtgctcatctggtgcgcctgatccgtggctggccaatcgaggctgtggactctacgccacttcacgccaccgacatcgagctgcgcgaccacgttatggacgccgtagtgaagaacgaatggggctatgccagcgacatgctggtccagctccgagcacaaggagtaatcgaatgaaacgagacaccaagatgaagctgttcaaggccaccgtgaagttccgtggcgagatgcaggaagtcccgatctgggccgagtccatcgagaccgctctcgaagtggccgatctggaatacggtgaggacaacgtttaccggctgcgtccagaggtgacggtatgaaccgcgcccaaggcaacacccggtcgatgcctgatggcttcctgcacatccagaacttcaccgtgaccaaacactctggcatggccggagtcgtctacatccacctgatgaccaaggaacaacaggagatcgttgagtcccttctggtcgagcgtgcgacggtccttgaggccatcgctgaggatgctggcgtgcccactgaggtcgtccatgtgaagcacggctgcttccggttccgcaaagagttcctcaaggagaacttccgtgaggtcgtccatgcgaccaccaagatcacccgccagccagtcattgaggacttcaaagggaagctgatcgccgagcgcgaatcgctctcctattaaaaaccctcactgtggctgcacacattcccaactgattcaaaggagacaatcacatggcaaagtccaccaagcaattcctgttcactccagtcggcaccgctgagccgtactgctcgatccagaagcctgacttcggcaaccctgagaagggcttcggtaaccctcgtggcgtctataaggtctcgctgaccattccttcgcgtgaagcccagccgttgatcgacaagatcaccaaggcttacgacaagaactgggctgagatcagcgaagcgtgggagaacggcggtcgtgctgctgctcaagccaagctggcccgtggcaagaaactgctggaagcctatcagggcgagctgcctttcttcgagaacgaagatggcaccgtcacgttcaagttcagcggttatgcctcgtacaaggaccagaagactggcgagaaccgcgacatcgttctgcgtgtcgttgacgccaagggcaagcgcatcgaagcggttcctgccatcgctggcggttccaagctgaaggtccgcttctcgatcttcccgtacaccttcggtgccgttgttggtgccagcgtgaaactgcaactggacagcgtgatgctgatcgagctgcgtgagttcgctgctggtggtgacgactgggccggtcaggaagaagaaggctacgaagctgctgacgaccgcgaagaaggctggcgcggtgagcaggacgatgaccaaggcgaagaccaaggtcagtacggttcgggcgacttctgatggcgcagggcagacgacaaacatgcccgcgttcttacatcgagtccaagatcaccaagggagactgctgggagtggactggtgccactttcagtaagacagggtacgggatggcgtgctggaagtccaagacagtaacagcacaccgtctctcctttacggcattcaatggggaaatcccagagggtctcgttgttcgacatacgtgcgacaacaggaagtgctgtaacccagagcatctgatcttgggaaccctcaaggacaacatggaggactgcgtagagcgtggccgcatagctcgtgggagttcccaaggtttatcaaaattaaccgaggaacttgccatcgagatttttctctcgaaggaacctcagagacaccttgccaagcggcttggtgtatcgcaacccaccatcgggagggtaaggagacgagagacatgggcgcatattacgcagggcctcgtaacgccagagtaggagctttccgctctggtcttgaggacaagaacgcgaagcacatggagaagctcggggtcaagtatgatttcgagaagttccacatcaagtacgttgtacccgcacgcgatgcaacttataccccagacttcgtgctggctaatgggatcatcgtggaatgcaagggcatcttcgagactgacgaccgaaagaagcacctgctcatccgtgagcaataccccgagcttgacatccgactggtcttctcgaactccaactcgaaaatctacaaggggtcgccaacgtcctacgccgattggtgccgcaagtacaacattcaattcgctgacaagctggtccctcgtgactggctgaaggaggctcgcaaagagataccccaaggggttctcgtaccgaagaaaggaggttagtcatggccaaggttcaattcaaaccgcgtccagccacggacttcatcgtggttcactgtgcggctaccaaggccagcatggacataggcgtccgtgagattcgccagtggcacgtccagcaaggctggctcgacattggttaccacttcgtcattcgtcgtaacggcaccgtcgagaacggtcgtcctcacgatgtcattgggtcccacgtcaagaactacaacagccgagcgctgggcatctgcctcgctggcggtatcgacgacaagggtcaaccccagaacaacttcacgcctgagcagttcgcatcgctcaagctgctgctgatcgccaacaagcgtcagtacccgcaagcccagatcgttggtcatcacgacctcgactctggcaaagcctgcccttccttcaaggtctctgactggctcaagacggctggcatttaaaaaccctcactgtggctcacatggattcgttccgtgtgggcctctttgcgttgactttaggaggacattatgaaccgttccttactgcaaggcggtttcgacctctgtgagcatctcattggactgggcatcggcgcgatcatcgctggtggctgtgcccgtgacctgttcttcggggtggaaccgaaagacatcgacatcatttgcgcgggcagtgacccggagacagtttccagagcgctcgatgaaggtggttattcctacgagaagttccccaagtaccacaccgggtctgactcggatcggctgcaaggggtctggaagatcgaaggatcgaacatcgacgtgatcctctacgagaccgattgtgtctccgaggcgatccagaagttcgactacaacctcaaccagttcgccatcgtgggcatccaacggggcatcgaaggggcgaccattcgcttcatgggtgcgagccattggagcaaccttgtgagactccgtgaggatgctcgtgggtcgcgtgccgagaagatggaagccaagtggctggacttgatcgacaaggctccaaacgtggatgagcgggaggtggctgatgtcgtctcctgaagaaagcgaaagcgtattcctgaagcacatcccctgtgagaactgtgggtcttcagatgccaactcgcttttcagtgacggccaccagttctgctttgcctgcgaccactacgtcaagggtgatggagagtcatctggtgagcgtgtccagaaggagcgcaactctgactgcatcgagttcgccaagtcccaaggtcgattccaagacctgccagctcggttcattcaggaggctatctgccgccagtatggctactgggtcggcaaggtctggcacccgatcaagcgtgaagtggtcatggctcaagtggccaactactacgatgctcagggcaacctgacaagccagaaggtgcgggacgccaccaaggagttcttcaccgctggagcacacgacaaggacgctctgttcggtcgccagctctggtctggtggtcgcaagatcgtggtcaccgagggcgagattgactgcctgacagtggctcagttgcagggtggcaagtatccagtggtctccattgggcacggctccaaggcagcgaagaagacctgcgccagtaactacgaatacttcgacacgttcgacgagatcatcctcatgttcgacatggatgacgctggtcgggcagcctctcaggaggccgctgaggtactcccaccgggcaaggtgaagatcgctgtccttcccttcaaggatgccaacgagtgcgtcaagcagggcaacgccaaggctgtcactgacgccatctggaatgcccagcctttcgtgcccgatggggtcgtctctgcgaagtccctaaaggcccgcttgaaggagaagaaggtgatcccttcgcttcctctggtggcccctcacgaactcaagaagatgaccaaggactgccgtggtggtgaggtgatcctcgtgacctctggtagtggctcgggcaagtccaccttcgtgcgtcagaacgtctacaacctgttccacaacgagtccattccgtgtggcgttgccatgctggaggaagccgttgaggaaaccgttcaggacatcgttggcctgcacatcggtgctcgtgtccgtcagaaccctgatgagaccactgaggaagtcttcgaccgcgccttcgatgaaatcttcgagagcgacaagctgttcctgtatgacgcctttgcggaagccgctgaggatcgtctgctggcgaagctggcctacatggtcgaggccgaaggttgccgggtgatcgtgctcgaccacatctcgattgtcgtgtctgcaatggacggcgatcaggacgagcgtaagaccatcgaccgactgatgaccaagattaaggcatttgccaagaccaagaacgtcgcagtgttcgtgatctgtcacctgaagaaccctgacaagggcaagccacacgaggaaggccgaccaattgttgtcaccgatctacgtggctcgggcggtctgcgtcaactgagcgacaccatcatcgcgctggagcgaaaccagcaaggcgcattccctcacatcatcctgttccgcgttctcaagtgccgcttcacgggcgagacgggcgtggctggattcatgcgttacgacaaagcaactggtcgcctcgaaccaatgccagaaggctggaaacccgaggacacatccgaagccgatgaggcgtggaaagaccagcaagaacctgacttttaactgaaggagaaccaccacatgaaagcactgaaatcgttcgacatcgttaccgctctgatcgttctggctggccgcatcgccaagcgtcgtcacgagaagctggtcgcccgtgaggcgtccctgaaggctgccattgcggctacccaagctgcctatcagcagaccgtctcggatcgcgtgcaggccgactggcgtcaccaagacatcacccgagtgaagtaactcaaggggtcctttcggggaccctttcggttaactcacacgccactcaataggagatacaccatgaaccattccgacatccgcaagtacctgaagcaaggcgagcaggccgtcgatgttctcaagtcgctgggctacacctacgtggccaacggcaaagagcaccctcattgggtggcccctgtgaatcctctcgacccgatcattgagggtatcaaggcgatggtctccgagcaggtcgctgcgaccatcaaggaggaaacctcgaaggcatacctcaagggcgaagctgacgcgatccgcaacaccgatctgcgtggtcctcaatgggactccgtgaaggacctcaagggtctcccgttcagcatcatggtcgccaagattccgagccactcgaaactccacggctactcgatgacccacttcaccaatcggcagttctcctgccttgaggtgcgctaccaccgctcgcctgagtacaccggctatgccgtgttgttctcgttccccgtgcgtccattccaccctgagactgtctggctcccactgagcgcctgcgtcttccgtcgataggagggcaaccatgctcatctctgacatcgaaacgaacggcctccttgagaccgtcgataagttccactgcgcgaccattcaggactggttcaccggccagtacacgcgcttcaatgaggccacctttggggactacatcaaggccctcgaagctgaggctgcgaagccggatggtctcatcgtgttccacaacgggatcaagtacgacatccctgcgctggacaaactgaagcgccaatacttcggcaagcgtctgaacatccctcgcaagaaggtgctcgacacgctggtactggtgcgactgatccactcgaacatccgtgaccgtgacgctgggcttatgcgctctggcatcctaccgggcaagatgttcgggtctcactctctggaagcgtggggctatcgcctcggtgagatgaagggtgagtacaagcatgacttcatgcgccagctcgaagcggatggtggagtctacacgccgggtctcgaatgggctgtctgcaaccaagcgatggaggactactgcgagcaggacgttcgcgttacctcgaagctccttcggaagctcatggaggactcccactacttcgtggatggtcaggccattgagtgtgtccgaatggagcacgctgctgcatggactctggcccagatggagcgcaacggattcccgttcgaccttgaaggtgctgagcgactctatgcggaactcgcagggattcgccaagacctgctgaccaagctcatcaagaccttcgggtcgtggtatcagccgaaaggtggcaccgagcagttccgtcacccggttagcgacaagccactggagacgtggaccaatgggccgttcgctggtcaagccattcctcgtgtgaagtatccgaaggtcggtggtgtgtacaacgccaacggtaaaaccaaggacaagcgcgagaccttcgctggggcaccatacaccccggtcgagttcgttaccttcaatccaacgtcacgccctcacatcatcaagatgctcaagaaggctggctgggaaccctctgagttcaccgacaacggtgctccgaaggttgacgatgaggtgctcgaacacgtccgcgtagatgacccagagaagcaggcagcgattgagctgatccgtgagtacctgatgatccagaagcgcatcggcatgttggccgaaggcgataacgcatggatcaagctggtgggtgaagacggtgcgatgcacggttctatcaaccccaacggcgctggtactggtcgagcgactcacgcctacccgaacatgggtcaggtcccttctgcgagtgccacctacggtcctcactgccgtgcgctctttggggcgacccatgcgaagaagcgtaagggctgggagaaggtcgtccaagtgggcaccgatgcgagcggccttgagctgcgttgcttgggccactatggggcacccttcgacgaaggccgttatgcggacaccgtgctcaacggtgacatccactgggtcaacggcaaggctgctggcatcatcaagttcgacgagcgcgataagcacaacgaagaacatgagcgtgtccgtggcatcgccaagacgttcatctatgcgttcctctatggcgctggtgatgaactcgtgggttcctttgtgggtggcggtaagaaggaaggcaaggccctgaagaaagacttcatggagaacaccccggccatctctggcttgcagggtgcgattgccgaccagctcatcaccgagcagaagtggaaccaagcgacccgccgtttcgacatcaagtggaagcgtcgttggttgcgtggtctggacggtcgcaagattcacgtccgctctccccactctgcgttgaacttcctgctccagtccgctggcgcaatcatctgcaagaagtgggtcgtcgaagtcgaacgaatcctcatggaagaacatgggctttaccacggctggtacaaagacgatggcacgcccggtgacttctgctacatggcgtgggttcacgacgaactccagatcgctgcacgtacacccgagatcgctgagatcgtcgctaaggtggcccaacaggctatccgcgaagtgggtgaatctttccaattccgttgccaactcgacactgactacaagatcggtgcgacgtggcgcgaatgtcactgataggaggccaacatggctaagactctcaaactgaacgtgtccttcccgatgaccatcgtggttgcgaccgacaccatcaccgctctgaaggcaacccgtgaggaagcccgtttgatccccgctgagaagatcgctgagctgaagggcgagaccaagttccgcgctgagttgttccgtggcgacaagtccgaggaagaactgctggagctgatctaccgcgcaggtatccgtgagttcatcaccaaggacatgcgcaacgagatcgcaggtaacgaagccaagattcgtctgggcagcgtaagggtctccttcgaggacaactccgtgctggcccggtcgtgcgactgcaatgcctgttacgagtgcaagatcgccaacggtggccgggatgaatgagtacctcgtgaccctctggggactcaagaaggctgcccgtgcgtaccagagcgacttcgttcgtgggcgcattgcgctggtcaatgaggcagcttgccgggggcacatctcgtgcctctcgactgccggtaagaacatgggcttctggtctctcactacgagcggccagcagttcctcgcacaatatggaggtgccctatgagcaaactgaaagtgggcctcgcccttgacatggactacctcatcttcagtgccatgagcgccagcgaagaagaagtggactggggcgaagacgtgtggacgctgaactgcgatcacaagaaagcccgtgacattctgttcggcaccctcaagaccatcaaagcggacatcgctgggcagctcaagcgcaagtacaagctggctcctgaagcctacgagttcgttgatctgtgcatcctgtcgggcgacgacaactggcgtaaggaggtccttgagacctacaaggccaaccgtaagggcaagcgcaagccagtaggatacccacacttctgccaaggcatcatggaccacttcggtcctgagcgttcgttcaagtggcacggtgtggaaggtgacgacgtgtgcggcattctgatgaccaatccgggtctcgctggttgcgaccgggttatctcggtgagctgcgacaaggacttcaacacggtccccggttacttcttctggttgacccagatggagcttgtgaagaacgacgaggcgactgccgacaagttccacatgatccagaccatgatgggcgacgttaccgatggctatggtggcatccccggtgtgggcaaggagaccgctaaggagttcgtcgagaaccctgagttcttctatcaggccaccaaggtgatgaagtccggtccacgcaagggtgaggaagtgtcctattggacctcctgcaagagcggtgacgagcagttcgacctgttccaaggtcctgacctctgggcctgcatggcgtccctcgcagcgaagcaggggatgtctgaggaagacctcatcgtccaagctcaggttgcccgtatctgccgcgcaagtgacttcgatatgggcaccatgaagccgatcctgtggcgtccacacgattcgtccctgcgccgctctgctgcctaaaaaccctcactatggccataggggaccgttaggttatctctgtggccttttcgtttaatggagggccaatgctcaaagttatccaacatcacatccaaaaccctgatgacattcctgacatcgctccagccgctgctgagtacctcgctgtacgcctgaacgcctcatacctgattgccactggcatcgtggatgacctgcgtaaacagggctactccgagggctacattgcgggcttccttgacggtgctaacgctgctgtcgagatcaccgagctgatgcaggaggctcagttacagaaggaggaatgaccatgtgcttcaaatccaaggtcaagaccccaaagaccaatcctgattccctgaaggcacccgagccggttctcattgaggaacccaagggtgtggacttcggggcctcggaagatgaccaatcgaccgagactgggaccgactctctgaaggtcaagaaggactccaccagcgacaagggtgatgggtctacaaccgccactgccaaggataccggcatgggcaagaccatctctgcgcctgttaagcgggcaatgaagaaggtcaccaagtgataacccaatggcgtcaatgcggggaccgcgcggtctttcgtgagcgcttgagggagatcattgagcagttccctgagatgacatggactcgttccttttacgaggcccatgcggaaatctgtgcggccactgagtcactcgatgagtgggtcgagctggtcgtgagagatgcctctgggaagctcgtggggttcgctgtagcgacggacgacgatgacagccatgtaggtgcccttctgggcgtccagtggcgcatggtctttccagaggccccagcgggcacctgcatgaagctccaacgtggcctcattaagctggcccgtgaatgcaactacaaggtcatggcgtatacccaccgagtgggcgaaggacgctatgagatcaactacacgaaactgaaggagaaacccaatgggcaagaagatcaagaaggccgttaagaaggtcaccaagagcgtctcgaaggtcgctggcgtggcctctggtggcctgctgggtggcagcgaagacaagccgaaggaagtggtccaacaggccgctccagtggaagctcctgcacctgtagcgaacgctgctgctgtggtcgaagcgccgaaggattccagtgatggtgaggacgattccgataccgaagctgcgaagaaggctgctcgtgccaagggtaagcgtggcctgtcggtagctcgctctgccggtactggcatcaacatctgacaaggaggtgaccagtggccgagaccaaacgagaaggtctcgctgaggaaggcgcgaaagccgtttacgaacgactgaagaacgaccgagtaccttacgagacccgtgctgaaaactgcgccaaggtcaccatcccttccctgttccccaaagactccgacaatagctcgactgactacacgactccgtggcaggcagtgggcgctcgtggtctcaacaacctgtccgcaaaggtgatgctcgctctgttcccactgcaaagttggatgaagctgaaggtctccgagtggcaggcaaagcagctcgttagcgacccttcgcaactggctgtggtggaacaaggtctgggcatggtggagcgcatcctgatgtcctacatggaagccaacagctaccgagtgacgctctttgagttgatccgtcagttggcccttgcaggcaccgctctgatctacctaccaccacctgacgcatcgtccaattcgtacaacccgatgaagctctacacgctccacaaccatgtggtccagcgtgatgccttcgggaacgtcttgcagatcgtgacgctcgacaaggtggcctatgcggcactcccagaggacgttcgcaacagcctctctggtggccaagagtacaagcctgagcaggagcttgaggtctatacccacatttacatcgacgacgagtctggtgacttcctgagctatcaggagatcgaaggcgttgaggtcgatgggagtgatggtcagtaccctcaagatgccctgccgtggatcgctgtgcgctggaccaagcgagatggcgagcactacggacgttcacacgttgaggaatacctcggcgacctgaactctctggagtcgctcaatgaggccatgattaagttcgccatgattagctcgaaggtcgtcggccttgtgaaccccaacgggatcactcaggttcgtcgtctggtcaaggctcagactggtgacttcgtggctggccgtaaggcagacattgagttcctgcaactggagaagaccgctgacttcactgtggccaagtccgttgctgatgccattgaggcacgcctgagctatgtcttcatgctgaactctgccgttcaacggtcgggtgagcgtgtgaccgctgaggaaatccgctacgtcgccagtgaactggaggacacccttgggggcgtctattcgattctctctcaggagctgcaactgccaatcgtgcgagtgctgctcaaccaactgcaagcgacccagcagattccgaacctgcctcaagaagctgtcgaaccaaccgtaacgactggtgctgaagcactgggccgtggtcaggacctcgataagctgacccagttcctgaacgctgtggcaaccgtgtcgcagttgaatggtgaccctgacctgaacgtgaacaacatcaagctccgactggccaacgccatcgggattgacacggctggtctgctgctcaccgaggccgagaaggctcaagcgcaatcccaagagatgctcaagcagggtggcctcaacgctgccgctggtattggctctggggtcgctgctcaggctaccgcaagtcccgaggcaatggagtccgctatggacaccgctggggttcaaccggggccaatcgccactcaggtttaaaaccctcactatggctgcatggagacttctctgtgcggccttctttctgataactcaaggagacctcaatgtccgacatttatgccgagttcggcgtcaacggggcagtcatgtccagcaacaacatcaccgagcacgagcagaacatgctggctctgccgacctctgtccgtgatggtgatgagtccatcgagaccatcgacccagagactgaagtcgagctgggcaccgagcaggatcaggagaccgatgtcgaggtcactgacaacgaagctggcgatggtgagaacgatgctgctgaagaaggcagcgaaaccgagttcaccccactgggcgagcctgatgctgagctggtcgaatccagccgtcagatcgacgagtacgccgaaggcttcagtcagatgcgcgagcaagccatcaaggctggtctcagtgccgaagtggcagaccagatcgaagcagaatacgagcgtgacaaccagctctccgaggcgtccctgaaggcgctcgaagcggcgggctacagtcgcggtttcgttcgctccttcatcaacggtcaggaagctctggcgaacacctacgtggcccagattcaggcttacgctggtggccctgagaagttccaagcgatcctgtcgcacctcaatgcgacctctaaggacgccgtggcttctctcgaaaaggccatcgagtcgcaagacctgcacgccatcaagaccatcatcaacttgggcatggcgagtcacaccaagaagttcggtaagacccctcaacgttcggtcaccaagcgtgccccagcgtccccagcggctgcccgtaagagcaccgtcgagggcttcgcttcgcaacgcgagatgatcgctgcgatgtccgataagcgttaccaagatgacgcttcctaccgtgctcaagtcgaggcccgagtgggcgcttcgagctggtaaggcactgatttaaaaaccctcactatggctgcatgagagttctttgggatgaccccaaggactccatgtgcctatcaattctgcaaaggagaactacacatggcaaacgcaactggcggtcaacaaatcggtgccaaccaaggcaagggccaatcggctgctgacaaactggctctgttcctgaaagtcttcggtggcgaagttctgaccgcattcgtgcgtcgttccgtcactatggacaaacacatggtccgtaccatccagaatggtaagtcggccagcttcccggtcatgggtcgcaccaagggctactacctcgctccgggtgagaacctcgacgacaaacgtaaggacatcaagcattccgagaaggtcatccagatcgacggcctgctgacttccgacgttctgatctacgacatcgaagatgccatgaaccactacgacgttcgtgccgagtacagcgcccaactgggtgaagctctggccatcgccgctgacggtgctgttctggctgaaatggccaagctgtgcaacctgcctgctgcgtcgaacgaaaacatcgccggtctgggccaagccgttgttctgaacatcggtgctgctgctgatctggtcgatgtcgaagctcgtggtaaagcgatcctgaagggcctgactctggctcgtgctcgcctgaccaagaactacgtccctgctggtgaccgtcgcttctactgcgccccagaagactacagcgcgatcctgtccgctctgatgccgaacgctgcgaactacgctgcgctgatcgacccagaaaccggcaacatccgcaacgtcatgggcttcgaggttatcgaagttcctcacctgaccgtgggtggcgctggcgacaacaacccagccgatggcgtggctccgaccaaccagaagcacatcttcccggctaccgccactggcgatgaccgtgttgctcagaacaacgtggtcggcctgttcaaccaccgttcggctgtcggcaccgtcaagctgaaagacatggctctggagcgcgctcgtcgccctgagttccaagctgaccagatcatcggcaagtacgcgatgggtcacggcggtctgcgtcctgaagctgctggtgcgctggtcttcaccccagccgcctaacggcaacccaaaccccttgaggcccttacggctttgaggggttttttcattaggaggatcaacatgcgctcttacgaagcaacactcgaaacagatgacgaactcgcagccatcaacgacatgctcgcagcaatcggtgagtcccctgtgagttcccttgagggggaccctaacgctgacgtggcgaacgctcgccgcatcctcaaccaagtcaaccgcgaagttcaatcgcgtggctggacgttcaacattgaggaaggcgctgtgctctccccggactccttcagtggactcattgagtacctctcggactaccttcggatcaccacctcgggtggcaccgtttacgtcaaccgtggcgggtacgtctatgaccgctcgaccaagaccgacgtttacaccaacgacatcacggtcgatctgatccgcttcaagaccttctctgagatgcctgagtgcttccgctcgtacatcgtggcgaaggcttctcgtcgcttcaacatccgcttcttcggcgctggtgagatcgaagggtctctgcaagagcaggagtcggaagcgtggcagcagtgccaagagtacgaactggactatggcggcttcaacatgatcgacggtgactcttacgtcggtggcatcgcatctcgataaggagggcctatgggactcgttagtcaaagcgtcaagaacctcaaaggaggtatctcgcaacaaccagacatccttcggttctcaaaccaaggtgctctgcaaatcaacgggtggtcctcggagactcaaggacttcagaagcgaccaccaaccaccttcaccaagcgactccagaacaagggtttcctcggcaccaagccgctggttcacctcatcaaccgggacgcccaagagcaatactttgtgggcttctctgggaccggtctggcagtctgggacctgaagggaaacaactacaccgtgcgtggctacaacggttacgccaactgtgccaaccctcggaccgacctgcgcctcatcactgtggccgactacaccttcgtggtgaaccggaacaccgtgtgccagatgggatcgaccctgaccaacccttcgtacccacggctggacggtcgagcgatcatcaacgtgcgtggtggtcagtacggtcgaaccctgtcgatcacaatcaacggtgacggcactgggtccagtcctcaagcgtccattaagatgccaaacgggtctgccgagaaggtgcccgctggtgacccatacgctggcatgaaccaagtggacatgacagatgcctcatggatcgccgctgagctggcccgtcagttgacggtgactctgggaggctctgggtggtctttccaagcgggcaccgggtggattctcatcaatgcccctgccaacgacaacatccgccagatcgcaaccaaggacggctacgctgacaccctgctcagtgggttcatctatcaggtccagaccttcacgaagctccctgcgaacgccccaccgggttacctcgtggagatcactggtgagtctgcccgttcgggtgacaactactgggtccaatatgacgcctctgggaaggtctggaaggagacagcgaagcccaagatcatcgcagggttcaacaacgcaacgctcccacacgcgctcgtgagggccgctgacgggcagtttgactggactccactgacgtgggatggacgcaacgctggtgacgatgacacgaacccaatgccgtccttcgtaggctctgcgatcaacgacgtgttcttcttcaggaaccgcttgggtttcctctcgggtgagaacgtcatcatgtctcgcacctcgaagtatttcaatttcttcccgagcagcgtggcgaccctgagcgatgacgacccaatcgacgtggctatctcgcacaaccgtatctcgatcctgaagtacgctgtgccgttctctgagcagctcctgctgtggtccgaccaagctcagttcgttctgtcgagcaacggcatcctgtcgagcaagaccatcgagctggacctgaccactgagttcgacgtgagtgatggtgcccgtccttatgggattggtcgcggggtttacttcgcagctccacgggcctccttcacgtccctcaaacggtactacgcgattcaggatgtctctgacgtgaagtccgctgaggatgtctctgcgcacgttccgagctacatcacgaacaccgtccacgcgatccacgggtctggtactgagaactttgtgagcatcctttcggacggatcgccaaacaaggtcttcatctacaagttcctgtacctcgacgagattctccagcagcagtccttcagtcactgggagttcggcgatgcggccacaacccgtgtcctcgcagcctcgtgcattggctcctactgctacctgatgatcgaccggccagagggcctgtgccttgagcgcatggagttcacgcagcacaccatcgactattccatcgagccttaccggacctacatggacatgaagaagaccatcgtcctcggtgcctacaacatcgacacgaacctgacttcgttcgacgttcggactgcctacggtggaacgccgggtcctgagtccacgttctacaccatcgaccagcaaggggttctcatcgaacacgaggctcgggactgggcgaccaatccatacatctcgttcgtgggcaaccgggctggcgagcagatggtgatcggcaagcagtacatcttccagtacgagttcagtaagttcctcatcaagcagaccgctgatgatgggtcaacctcgaccgaggacattggacgcttgcagcttcgtcgtgcgtggctgaactacgaggaatctggtgccttcgagatcaacgtcaacaacggctccagcgagttcgtctacgtgatgactggtggtcgcctcgggattcaacgagtcctcggtgagttgtccgtgggtactggtcagttcaagttccctgtgaccggcaatgccgtcaaccaacgagtcaccatcaccagttccaacccgaacccactcaacgtgatcggatgcggctgggaaggtaactacatccgccgttcttccggcatctaacagtgaccaagtgggggcctcaaaaaccctcactatggcaccctatgagggtttctttatgatcttgacacaagcaaccaagcgtgaccttgaggaagcagcaggcaatctttcgttcgctgatcttcaagagttccattcccacaccagtgggcgcgatccatccgagacacttcctgcctgccttgacgagaccacgatggtcatcaaggtgggcgctttggttctggccgttggtggctccaagaattgcctgtggttcgtgacgaccaatgtggtccagtcgctgaccaagggacaacggatgcgcttctacaagctcctgcatgggcacctcaagggtctccgtgacagtgggcaccaatacctgaccaacttcgtgtcggtcgataactgggaccatatccgccttctcaactcactcggggctgtcttcgctaaggagcacaccatgagtccagccggatgtcggttccgtcaattctggctataggaggtgagctatgtgcgaaccagtatccatcggcatggccgctgtcgccctcgtgggtggcactatggctgcgcacgataagtcgaaggctgagggtgccgctgaggacgcccaacgccgatctgcccgtgagcaggtcaagcagatgaacatggccaacgccaacctgaacctcaacgctcaggacaaggcagacgaggcccgtaagcagctcgctgaggtcaacatgcaggccctgcgaaaccaagggaccattcgcaccgccatcggtgagtcgggtctctcagggaactccatgaagcgcattgcgaactccgtcgagaacgaagcgagccagcagcgcatgtccatcactgacaactaccaccgcgactaccagtcgatctttgcgaaccagattgccaacaccgagaacaccaagagcgccctcaagggtcaagcgcaggtcatcaagacctcgggcctgtcgaacgctctgggcatcatctcggcgggtgccaatgggtacgtccaagggtcgaacctttcgagtgccatgaagggcagctcggcaggcggttccaacggcacaccagcaggaggtaagacctaatggcaaacgatatttccagagcggtagatcagtcccgcttcggtggcactgagcggctccacggctccactgcgaccactcagttccaagcgtccatccaacgggcacctgtaggttccacgggtctcgctgaggccatgcagcagttcgtcaagtctggcagtgcagccttcgggacgtacaccgagcagcgccaaaagacagccgatgagaggtccaatgagatcatccgaaagctgacccctgagcagcgccgtgaggcaatcgccaacggcaccttgctgtatcaggatgacccgtatgcgatgaacatgctgcgtcagaagtcgggtcgctctgcggcctacgatgtcgaggatgaaatccagaccaagctcaacaatggtgagttcgatgggaaggaccgtaagtacctcgaagactaccgccagcaacgtttggcccagtctgcgaagtcctatgcggaatctgcgggcatcgacgagaacgaccctgagtaccaagcggggttcaactcggacatcgttcagcggaacgcgggtatctatgacctgcacgctcgtcgccgctctgcgtggtttcagtctcaacaggctgtgaacacccgtggcgatctggctccgttgttggacgaccccaatgtgatgcactcgccttcgggcggtgaggtcatctcgggctacttcaataacggcttgcagaatggttccttccccagcgacaagcaggccattgattccctctcgatgctcgttaaggacgtgcagcagaaggacggtggcaccaacctgcttcgctccctgcgagaccagaccatcaacgttctgggcggtcccaagaaggtcgctgacctgatcgacccggacatctacgagaacgccatcgcgcaatccgaggcgaacgagtacaagcgctatcagagccgcagccgtgagtttgagctgggcatcactacggccatcaatcaggagaaccctgagaccggctggcggatgctccaagacctgcgggcgaagaatggctggctccaagggtcggacaacatgacccctcagaagcagaagttgattgacgctgagcagcaaatgatcggcatggttcgccagcaatcccaagcgaccgccaaggagacccaaaaggccatccaaggggacgctcgtgttggctacctgaagcagcagtatgaggctcgaatcagtggccagaacgtgtctgtcgatcccaagttccaaccggacatcggtgcgggagagtggaaaggcgtggacgcaatgaccgctgccaacgagatcatggccgacatcaccaagtcgaatctccctgacaacgtgaaggacgccaagcgtgctgcttatctgcgcgctgactatcagggcggtccattccagacctactaccaagcgctcatcactgacgcccagcgggaatggagcaatgcggttcgctcgggtgagccgggtgacatgactcgaatcactgagctgcaacgtgcctacgctgctgaccctgccaccatcggtgcggtctacccagagcaggctgacttccttgagcagatgaaggacatggctgactcaggcgctgacccgagcgtgttgatcgccgctgagaaggccaccaagaacatgagcatcgacgagcgcaagttccgtgaccaagcgtgggcagacctgaagaacgattccagcgccaaggacctgacctctctaccgggtccccttgagcggatcgctcggactctctacgacggttacaacgagcgcaccggcaacgccaagcaggcccaacagaaggtctctgagtggctccagaagaacaccgttgcgttcaccgaagatcagggcgggacattctccagtccagaccaagggacgctccgtggtcgtctctcgaagaaagccctcatggctgacccagcagacgttaactcgtggcagggcggtcagagcatcgtcgaggacaccttgaagggcctctctgagaaccctcaatgggccgacaccgggatgaccgtggaaggcaccgactctggggacatcgttatcagctcgctcaacggcaagcgggtacgcattacccagcagcagatgcaactgatctacaaggctcgccaagcagcagcggctgagcagaagttcaacgagaagaaggaatcggtgaagaccggccagcttctctacaacgacgtaatccgagggggccgtggccctctctaacaggaggtctacatgaaccgcaaagacgaatacgccaagctggtagcagaaggcaccccatacgacgacgcaattcgtcaggcagcagatgccaatggggtcccctatgagtacctgcacaagaagattttcatcgagtccagcttcaaccctgacgccaagtccccaaccggacctctgggtctggggcagttcaccaaggcgaccggcaaggcttacggtctgatgaccgatgaggatcgtctggacccaatcaagtccatcaacgcttccgctcagtacacccgtgacctcatgggcacctacaagggcgacatgctgaaggtggcactggcctacaaccaaggcaacggtcgtctgggtgctccccagttggccgcgctggatcgtggggacttctccaagatcagccacgaaggtgccaagtacatggccaacctgctggacgtggcgggcgactctccgaaccgcaagtggttcgatgggaatccccaagccccaaagctcaactctgacttcgagcaaaacaccaacggggtcagacaccagccaaagggtgtgccggaacttcccgagtcgcagggcttcaaccttgccctcggggatgctcctaaagtccaaccaacgttccgcgagatggagatcgaccagaacggtccagagaagggcgcatgggacaacacatgggatgccgttaagtcgtccctattgaccagcgtcccggctcagatcgctcggaacatcaccgtcgaggaccatgacccgttggactgggtgaagcccggtgacacctcgaactggagcgatcaggacttcgagaacatccgcaaggaagggatcgacccacaatacttcggcttcatcttcgactacaccaagggcagccgtgacaagctcccagaggcaatcgccttggcgaaggagaacgctgattatgatcgccggatcggcaaggctggctgggctggtcaactgaccgctggcgtggctggtgctgctctggacccgctgacctacgttcctgtgcccggtggtgctggtgcctcgttcgctgcccgtgtgggtaagcaggctgccttcagttcggccatgtcggtcggctctgaggctctgcgtgagcaggccactggtatcgaaggccactatgctgctgctgctgtaggtggtgccgtgatcggtggtgcggctgctgctgctctggacaagttcattgccaaggctgctgtctctggtcgtgccgatatggccgatgctgacgtggaagctgtactggctcgccacggcgaagctggtctgcctaaccgtgacgttgagttgcctgaaggcatggcaccagtccagcgcaagccggaagatggtgagatggacgatgactatctggagaagattctgggtctccacggtgagcgtagccacaagcaggaaggcttcaagacaatggccgacgattccgttgagtccatccttgcgcgccacgctgagtcgtctgagccaaacgagttctatggccctaccagtcgcctgcaagcccgtgaggctgctcgccaagctggcgtagatgacccaacccgtatgccgatcaactccgatgacgcccttgaggacttcaatggggtgctctatgcggataaccccggcgagcgtggttcggttcgtctgcgagatggctcgatcctgtctggcagtaacccgctcaatccgaagaccaacaagctggccgctgagatcggtcctgaccgttcctctaaagggttctcccttggggcgatcactgagatcggctacaagctgaatcgctctgaggaccctgacgttctggacatcggctcgaaactgttccgttccacggtgcagactgagagtggctccaatggacgctttgcggctaccgcttcggacatcattgaacgccttcgtggtgaggacaacctgtcttatgggaagctcaacgacctcactgagagcctcctgaagaacgacccgaagtatgccggtatggatggttcgaggctggccctgatggagcgtgcgtatcgccgcgtggcggaagctatcgaggactcaacgaacgccaagaaggccatgctgagcaagcaggagaaggagctgatggaccacatcaacgagcacttcacccgcaagcaggacgtgttggaaaaccctgcccagttcggcaacgctcaggcgaccgctgtgctggaccagagccgacacgctggccactatgtgcctaacgtctatgacgacgctgcccgtgcgctgtacctgaagaagttcggtggcgctgacggcctgcaacaaggcatcaagtcgagctggctggcgtcctacgcttcccgcgctgctgtcaaggctcgggtggacaagttcatcaaggaagcaatcgaaaaggaaggcaaggtggcaacgcctgagttgatcgcccagcgtgtcgagcgctacgcccatgacaaggcatatggcatctcgcacactcaggacttcaaccgttcggccctgatcgacgatggtcttgattcgctggtgggtgctgagaacaacaacttcctcgaagcccgtaacctgtttgactcggacgtgtcggtgccactgagcgatggttcgtcgttctcggtcaatgacctgcgcatgtatgacttcaccaagctgatgccatcctatgaccgccgtatcaacggtgacgtgggtatcatggctgcgactggtgagggcaccgatgcgctcaaggctcgtgtcctgaagatcaagaccaccaagggcaacagctctgacgtggaggcccttgagtctgccgttaagctacttactggtcgcgctcgtcgtgacccagatgatgcctttgggactgctctgcgatccctcaacgacctgtccttcttcaccaagaacgcctacatgggcgtgcagaacttcaccgagatcgccgggatggtgaccaatgggcatcttcggatgctgatgcacggtgtgccttacctgcgtgagatgaccacttggggaaccaagatcaaaccagagcagctcaaggagatgcacaacctgatcttcgggcgtgaactggatgacaccatccggcctcgtcgggctgacatcgtggaccgtctgcggactcaaggctcgaacaacttcgttgcccagaccgtaggctctgccaagttcgccactcaggaactggccgctcgcagtccgttcaccaagctgctcaccgagacttccaactacatcgctgacgctggccgtcaaggtgctctgatggacatgatccgagctgctcatggggacactccgagaatcctcactgacaaggagctgcatcgcctgtcgatcaccaagcaacagttcggtgacatcaagcaagcgatcgaggagcacatcgtccctgacggtgatggcttcaagatcaaggacccggctgctctgcgcagtgacccacggacaatggatatgtggcggatcggtgacaagatcgccgacgagtcgatcctgcgtccacacaagctgtcctctcaggactcccgtgctctgggtgctggctggcatatggcgctccagttcaagaagttcgtcttcaggtccctcaacggtcgcctcatgcgtggcatctacgactccaccaagaatggccgtggcatcgacttcgctattcaaggggtcgtcgcaacgggcctcgcaacgggcttcttcgtggcgcaacgctacgtgcaggcccagggtatgccaccagagcaacgcaaggacttcctcaagaactccttcacaccagagatgctgggctgggcagcgatgtcccgtaacaacatcctcggttctccaatcggcgtggccaacttcgttctcgctccactgggttacgacccggctgctgctgtgcgtacctcggtcctcccacgaggccctgagttcgtcgctaaggatcgtccagtacgttactcgcctctccgttcggatggcgttcagcgtccactgagcggccttctggagcaggttccgggtgccggtatcctcggttcggtctaccaagtaggtgcgaactctgagggtctctggaaggacactcgccgctcccaagagctgggctatatgaccggcatttacaatggactgcgtggcctcgtgccaaacgatccagtctcgcaacgtgctcttagcgccatgatgcaggaagcaggtatggaataccgcacccgctaaaacccctcactatggcaccctcaaaggctcacttcggtgggccatttttttaaaggagacgatatggctactacaccaaagacggtgcggacctacgctctcgacggcaccaagaaagacttcacgatccccttcgagtatctcgctcggaagttcgttgtggtcaccttgatcggtgcaactcgacgtgagctgatcctgaacaccgagtaccgcttcaccaccaacacgaccatcaccacgaccaaggcatggggaccggctgacaacttcgacctgatcgagattcgccgactgacctctgcaactgagcgtctggtggacttcgctgatggttcgatccttcgggcctacgacctgaacatctcgcaggttcaatctctgcacatcgctgaggaagcccgtgacctgaccgctgacacaatcggcgtgaacaacgatggtgacctcgatgcccgtgcccgtaagatcgtcaacctcgccgatggcttgaacgatggtgatgctgtcaacctgcgccagcagaaacaatgggctggctctgcgttgaaccaagcacaagctgctgctgcatctgctcaggctgctgccacgaacaacgcccaatcgctggtcaacaaccaacagtcctatcagaacctcgttgcggcccaacagcaagctgcgaactctgcgaactctgcgagtgcctctcagacatcccgtcttgcctctgaggctgcccgcgatgcttctgccgctgcccgtgacttgtcccaagcgtggtcctcgaaggctgaggatcaggtagtcgcatctggtctctattcgtcctaccactacagccgcaagtcggcagcgagtgccactgcgagtcagacctctgcgaccaactctgcgaactctgcgagtttctcgacgactgaagccaaccgtgcgacgactgaagccaaccgtgcgaagaccgaggctgacaagctcggtaacgcaaacgccttcatgggttcgattgattccgtaaccggcactactgtccgattcagagacgcttggacgatccgaatgggaactcaatgggtggacaacatctacggtaactccgtggacaaggttgccgtcaaggctggcaccttcgaggtagctggtgtgaccaacatggcgaacaagctgacgatcacatccggtggcctcaatgtcactggtgccgcaactctgggctctgggctgaccgtggctggctctctctcaacgggtggtgctgcaacaatcggcggcgctctctacgtgacgagcgttgctcaggttaaggctccagatgcttcgtccaacgccaacctatggttccgcgactctgatggtacgactgagcgtgcgctgatctatgcagatagagacaaggccctgcacatccgtgcgaactcaggcaacagtggtgagcttcttgttcgagctgacaacagcctcgtacttaacaacagcctcgaagtattccgtggaccagctaaccggcagccaaccttcttcagtccaactgcccagatcgacggctctatgtatggaaactgcaacctgcaacttcagggaactggaggtggtgtggcaggtctcggtttccacaacgctggtcgtgtggccgggtgcctgtggctcaacactgacagcaagctctggtacataaataacggcggctcgaattggcagttgactgataacgggaacatcttcaaccacatgggtgggatgacctcggacataatcggctgcatagcaaccatgcagaacgtatctggtgcaaaccaagtccagaacgctgttctcggtggcggctcacttcgttactcgacccacaacaacccctcgggcgctggcggtactggctcgtggcggaaccttggctggtcgaacaacggtggcgtgtctaactggattcgctacgcctaaccattcaggcccttcggggccttctttaaggaggacttatggactttccaaccaagttcacaatgctgactgtccacgacattcagaacccccgctggacctctctggagcacattcagatcgactgtgacatcaccgtggagtttccagatggtcgagtcgaaacgatcccattcacggcctgtccttgggacacctttggggaccactgcccagccatcttcgagcacgcggctaacatgccggggatcgtcgagtgggaacgcccagacgtgaccgttgaggacctgcaagctgagttcgacaaaatctggcctgatgtcctgctgggcctcgccgacgagaagaccatcgaccttgcgaagactctgcgcgttcagatcaaggcgatgagctgatggctggccttgagatcgacttcaccaacggggtggttcgcgctgcccctatcgccgctggagctggtgctgaagtagcaagccaagtggcaggcatgagcctgagcgattggttctacgccaccatcatcctctacaccatcgtgcaaacgttcgtgctggtcttcaagaccgtcatggatgagaagcgcaagaacaaaggagacccaccatgagtgacaacgttctggaaaagctgctggaggcaatcgacaccgagactggtcgtgccctcctgagcgaccttcgtgatgacgaccgtcgttcccctcaactgtacaacgccatcggcaagtaccttgagcgtcacaagttcaccatcgccaagctgaagcccgatgagtcccttctgggcgatctggccgctgccctcaacgagttccctgagctgggtgaggatgagctgtacggtgacggagtgcgccactaatgggcctcaaggagatcgcactggcagtcgttctggctgctggtgccctcggtctggcctacacaaaaggtcactccgatgcgaccgacacactgaccatcaaacaccaagcggaactactggccgctaacagacaactggaggttgaacgtgaacaagctcaacaaaccatcgcggccatctcaaaggaatggcaaggctatctcggttcgagcaaggcatctgctgatcgcgttgtggctgatcttcgcagt

SEQ ID NO: 18 - DNA, 40543 bp, unidentified
  misc_feature 1..11: note = bacteriophages nucleic acid sequence
  source 1..40543: mol_type = genomic DNA
ctccccggactcaatgagcatccgagcggcttccttggtgatgcaggtgttctcactcggtgaccaatacatggtgcccttagggacatcgctgtaggcacactcggtgacggtgcgaccgaccatctgcttgatgtcgcattggtcccactggtgcagccttgaggactcattgaggtagtggtcaccaccattgaggtaggcattgcccatgagtgcccattgcgacttgctaaagtgggccttgacgacacggagaacagcaggtgtgacgaactgagcgtagtagcgacgatgagccgcgctgccatcctgctcagggtattccgtggaggtcttgcggccatccatgtaccaatagcgggtcaggtagaccttatcgttgatcattacgatgtcagcggtgtgttgcttagccatggcgattgctcccaggttgttggtgtgacgttgagttgttcccatagagccctcaaggaaggccctacagtgaatcgctcaataacccgcccagcggcgtaactcgccgtagttcaggaagggccatggatgtaccttgccgttctcatagacccagatggcgaggtgtccagcctcagtgcgataccacgatttaaaccagtcgtgttgcttggcccatgtaatgacagcctcgtcgatgtctgggcgtggcgtgttgtgactcatggtcactccttgtcagcgttgagttgttcgagcaggtcagccttagtgcggtgccacacggcctcaaggacacggcagcgagtcagcgttgagtcaacctcattgcgcagcttctcccacataggatgagcagcagagccctcaaagcgcccaaagatggccttagcggcttgatgctcagcctcagccttcacaatacgtgcatcgaggtcagccagctcagtgcgtatacgatcagtgcgtgtactcatggtgatgctccttgcttgtgtgttaagagatacagacgaaggctctccacgtcccgtgctaatgcttagatacacgagagccctcttgctgtatttcctttcactgctacgcaccgagggtctgagcaagcccgttaagacgtcagcccgtctcagtgcgtagtgttgcagtccgagttgttaaagagcgtaagggtgcccgttaggccgtagttatcggccaattcgttgcccttcttgcgacccatgctggtgactttgacctcacccgacccaccctactcatgacatctgctcaggtagctcgttgcgtgtttcgttgttgatgtggcgtattctacagcgtgttgcggtgttgtcaagcgtttgtttctgcccttgtgtcgctcatcgttcgtcacccttaagacccttggcacacgtatgatcgcaggtcagatgctactaagctaagcgaccaactcagagacacccgttaggccgtgtctcgttgttgatgtggcccattgtatagaactgagcatcgccgtcaacctgtttattcatccagtgtatgctgatactcatcagctataggtcagcctgtaacaacacataggagccttgagcccttctatataggcaactgatcgaatcctaaggagtagggtctacaggcaccttataggagccctaaggagaggcgtcacatgatcaccctgggagtgacctaaggagcagcctaaggatggcctaaggattgctgatacagatagggacagatggactactgtatgaatccccagtgttgacagctcaccctttaggcccccatcatgtacctcaacgaaccacctaaggatcaccaccatgtagccaccattgagtcacctcatcgtatccctcagatgatcattgagatgccctatggggagcagagcccttgggatggctgagagaggccctatggggggattcgtgggcgtttgtctatgagaggtgccctttcagatttttctatcagattcttaaaggacatcctaaggtatccaatgggttcatgcaagtgccatctatcggttatcctaaggaagaccctaagggcctatgaggacacctaagggctttcttaagctgaccaatgaggtagggtgtaaccataccgaaattggtcgtgtcggtcactctacgcagccaccagatgccacacacacgaggccagagaccatgttcatgacatcactgccattgaggacacctaaggccaccagcaaggtgccgatgagcttgtaggtggtcttggagagagccaaccgcttgagtacgagcagcacggtggctttctctacgtccatggttgtggtctccttcttgataatgatcatagttgataaccatccttggtccagttcctttggtcggacctcatcctgaggaacccaaaggttagaggcaccaccttaagaaccttgctgagatcttgttaggaatctcttaggtatcttagggtgggcctctcccaatagtgagggtaaataaacttcgtcgatcatgcttcgatcatgcagacttcctaccagcccatatagttggtcattgagccttcatcgtcgaacatgatgtccacggagtcactgattgcgatccttctgacgtcctcaaagcccatcagttggttctccatctgggcctccaagaactcagccatcagttccgactcgcccagcttggaatccttctccatggcctcagtgaagaactggacgccaatcgcaagggcatccaatcggtcatcatgggccagcgatccacgctcacgggtgatccgagagagctgatagagcagactgtacttgatgtccgtggtcccgtcagcgttgagcgcagtccggtagtccttgtcgatgagggcctcgctgagaaccagcttatggctgcccagtacgggctccagaacgtcgcagatgcggagttccttctgacccttggacttgacctcagtgatcgcgcacggccatgtagcggtcagcacagggctgatcagcttgaggtacataccgtcaccgaagttaccctcgatcacgacctcgttgaccttgtagatcttggcgaggttcgagagggcttggagggttgtgtcctcgtagccaccacggaagccaccagcgtccatcaggaagatgtaaccgttcaactggtacagcactgcatagccagtctcatccttaccgcgccccgatgggtcgatcacaaggattttctgagcgtactgcgcagtggcctgacctacagcttcgtagcggtggaagcggtcacctttgagacccaccagaggaacgcctttgacctcgttgttggcgtttggcatccatgtcagggtggttggccccttcatcatgtcgaacgtccctacgatgaaatcacgcagcttgagcgggtacttctcggcgtcactgaggttagggttgagcatgaactggagggcgaagccacctttcccataggagagttcacgttccctgagatctgtatcgtcgaagcgtacagggtcagtcggtgcccagaacagggaaccatcagctcgcagctcagcctccagcataggagccagccgtgggccataggagtcccaatccttctgatccttagggtatctcgcaggccagatggtagtgacgtagccacggccttccagctcacgatagagggtcatctcggtctgaggggtgcccagatagatgatcgtaccgcccggtttcaggatcgcatcgaactccttcacaagttctcccagggcgtcacgcgcagactgggtgcccgagttgttcggaacctcaacgtcatccgcaatgaggatgtccgcacgggaacctgtgagctggcctgtgatacctaccgacttcaccgagggcgagtggtcaggcttggcgagacccacgtcgaaggccagagcggagtctcgttgacccgtccgtggtttcagctcgtggaggaatggaagcagctcgatgatccgcttgatgaagatggagttggcgtctgcccgttccttggaagcggacacgatcatgaacttgaggtccgggttgccccacagcttccacacaacgaatgcgcaggtgatgaaggacttgccgatacctcggaatgcttgaaggataaatcgacgttcgtcgccagagctgagcttcttggacatgtcgatctgacacttggttggtttgggtaggttgagggctctccacaggacaaaaagaaaggccacgaatgaccttttcattaacgctatgtcgtcgcccccattacggggtgcgctcatttagttcctccttggatggtcttaatggaatcttgcaggcccttcacttgggcgtctgctcgttgggcttgttcgataagaaatcgaccatcgctttctcgtagctcggcgcgaccatcagcgaggggtctaccgtcagccgtgacgcacttgacggtggcatctgcgagggcgactgacaggctgataccattgctacgcagaccagcaatagtccgatcagcagatgccttactcgttgagagatagtcttgccagttcttcgagacatcagcgagggctctttgggttgtttcacgttccacctccagttgacgggcagccgccagttgttcagtttgatgtttgagggtcagtgtgtcggttgcgtcagagtgacctttggcatacgtcagacctaagcctgtgcaaaccaaaaggccccacatgacgaactctttaaggttcaacatgcagggcctcctttagtggcgaacgtccgaggcgtacagctcgtcgtcagttaactcagggatctcatcgagagccgaagcgagatcgcccagaagggactcatcaggttgcagcttggcgatggtgaacttgtggcgttccagcagcttgcccacagcgttgtagagctgaggcgttctacgctcaggatcacggaggtcagccaacatgttcttcgccatgtcagtgtccagcgcgaccagcaggcgcatcagtaagtcatcactcatttctcagcctccttgtctttgcggcgttcttctttaacggtcttgtaaaccacgattacagtcatcacgagggagtacaaaacggcggatgcgtagaaccactcacttggtgaaaggcccagaaacaaccgggccgtcacgtcagtcacagcagcacctacgactggagtggcttgcaccaccccgttgttgaagtcgatagagatgcccattaggacacctcacgattgacgtagcagaacgtcaggtcataggtcgctttgtggtacgactcgatgtccttgatgcgtccatagaggtacttggcgcgctctacacgatcaggtgcagcgaggcccaattggacctcagggatgatcttgtcgaactccacacgaagcgcagagacctcctccatgagcaggttccatgcctcgatctgcgattggtcgggaccggaatactcagggatgtccccagcgagaccccggtcgatgatctggaatagttcattaccatgcgcaacttcgtcgccacgcacagcggtgtactccagccattcgtcaatatccgagaacttgacgaggcagtaggctgcatccttgttagggcagcaccattggacgttcttcacgtccacgatagatctgttagccattgggcctccttacgcatagcgcatgtaaagggttactgagtcaggcgatgcaccgtcagcgttgacgagcttgcccatacggacgtagctaccagccaagttgtagccagcgaagtaagtgccgccagtgttggtgccagtgaggttgccgccagcgacaccttcgttccactccacgcccgagttgttgtgagccagagccagcatgtgacagcccagagagttgactcgcagactggacatggcgatgccgatgttgttgacgttgcgggactcttgaactgcccaagcgttggcccgctcgttggcggtgctgtagatgtaaccggtcacccattggttgccaaaaacggaaccgtagatgtttccatccggggcgatctgcatgtactgcgatgaagggttaccccagcacaaggagccagcagcgttcatcatcagcttagaaacaaaggtcgcgccccagtggaaggagatgcccggtgcgttgtagatgtggccgggagctggtccaccgttacctacgaggccgctctcacggatctcaaaggcaccgttgtaaacttggttagcagccgagaggttcgtgtaggtgacgccacagacttggttgttgttgcccatcgtagtggtcccaccagtaccgcccagtttgtaggctgggttgaagttaccagttgaccacacgcggttacctgagtcgtaaaccccaccagtacccgagtagattgcaccagtagaccccgatgagatgctccctgagaaggaggcgttcaggccatctttgttcagttgaagcagcactgggccagtccccgctgagttgccccagtggagtgtcaaggcgtggttaccatcggttctcgtcaggacgcccatggacggcgcatggcctgctccagcctgaccatacttacctttgatgattgggtagtaagctgaggtgttgtcgagtacaccttcctgagtcaagaagggcgcagaggtggaccattggctggaaaaaccagtcgactcggtgtaaggctgggcctcaaagcgcttaccgaagaacgcacctacagcctgtacgatgcccttaaagaccaccttccagttcccatcaccgctcgcagtggacgagatgttgtcaccaataccaatcgcaccgcccaactgggaagcgcttgtagcagcctcagcggccttgttggttgcgatggtcgcctgagcagcagcgagactcacttgagcctgagcgtcggtcaccttttgggcagcctgagtggcagacgttgaggcagcgttggcgtagcccagagcggtagccacatgggcgattgccttctggacccagtggaacgctgagtattgcccagtgttgaccaccacgttctcagggttgttggcccacttgtaggcagtctgattggacaactcagagtttgtcgcagaggcagccgaggcgttcttagcggtctccgaggcaattcgatgggtgtacgattcgccagcgtaagtgatggacgtatcgcgggcactttcagaagccagccgggaagcctgagaggcagccgcagaggcagccgataggttcgcttggttgagcgctgagccgccccattgttgctcttggcgcagggtcacagcgtcaccgggattgatcgcatcagcgaggttcacaatgcgccgcgcacgggcatcgagttgaccatcgttgttcacgccgattgtgtcagccgtgaggtcacgagcttcctcagcgatgtggagcgattgaatctgagcggtgttgaggtcgtaggcccgaaggatcgaaccatcagcgaagtcaacgaggcgctcagtggcggaagtccaacggcggatctcgatcaggtcgaagttgtcagccggaccccacgcagaaccacgcaaggtggtgatggtggtcggagtggaaaagcggaagtctacgttgagtacaagctcttgccgggttgcgccgatcaagttaacactcacgaacttacgagcgagatactcgaatggaatcgtgaagtccttgagggaaccgttgagggcatacgtcttcaccgtcttggtggtagttgccatgtggtctccttaatgaaaaagccccaccgggttagggcagggcgtgagttgatgtatcccaatagtgaggggttattaacggaccttctggccgcgcttgccgtactccatgcccatctcttggaaaagcatgttggtgaccttctgagttgcagggtcgttcggcacgaggttacggaacccgttgtagatcgcagacttgtagtcctgatcctgagcccgaccttcatcgcggaacacgccagcggtgccattgccaatctgatagatcgacccgaggactccgaggccaggtacttgctcagcgaacttcgagagtgggtcttggatgcccgaggagcggagcggggaatatttcacagcgcggttccgttcggtgtactgaggaccacgaggcagaacagaggtccgcacagcagcagcagcatcgaaccccaaaggggccagagcgaagttggcgatacccaaaggggcaccaacgtgagagctacgagagcccgctgcataagcgatcatgttcatgtccagtgaccgcgacaggaagtcacggcgttcctctttaggcatcccctgagcttggacgtagcgctgggccacatagaagcccgaggcgagacccatcgagatcgccacttgttgggcttggtcgatggcctgcttgttcttggtggcgttatagaagccccgcaggaggcgactgtttaccgaacgcaggacgaagttcttgaactgcatcgccagcttgacccaagcgttctgcgcaatggcatcggtgttgctcagcttgtggggacgcaggatggtctcatcggccaccttgtcaccaatccgccagatgtccattacccgagggtcttgctggaacttggcccgatcacggatcttgaagccacctttgggatcagccacgagatgctccttgagggcattcgtcacgtcaccgaactgagccttggtgatcgacatcgagtgcaggcgatcctcattgaacagcttcgaggtcttcccagagagcgcatggttcacgaggtccacaaggacaccttgccgaccggcatcgaggatgtagttggaggtctcagtgaggaacttggtgaaaggcgaacgggcagccagctcaccagtggcgaacttgatggtgcccacagtctgagccgtggccccgctgtagccttggttacgcaggcgttgcacgatgtcagcacggcgaggacggatgaggtcatccagctcccgaccaaagatcatgtcgtgcatctccttgagttgctcaggtttgatcttggagccccatgtggtcatctcacggaggaaggggactcccttcatgagcatccgagtgtggcccttagtgatcagcccagcgatctcagtgacgttctgagcgcccatgtaggcgttcttggtgaagaacgaaacgtcagtcaaggcacgagccagtgtggcagccgctgagtcagggtctcgacgtgagcgcccagtgagcagcttgatggactcctgcaaggcttccacttcctgagtgttgccattcttggccttgatcttgaggatcgcgtccttgagggcagtggtgtccttaccagttgcagccatgatcccgatgtccccatttactcgacggttgtacgaggaggtgatctgaggaacgtcaaagatgcgcaggtcattaaccgagaaggttgtcccatcgctcagcgatacagccacgtccgagtcaaacaggtgacgaccttcgaggaagttgttggcatcctgacccaccaaaccttcgaggttatcgtcgatcagcgaggagcggttgaagtcagtcgtgtggctgataccgtatgccttgttgtaggcgtactcgacaacggccttcttgatgtcctcaggtgttgccaccttgccgttcttctccagcgactccttgatcatcttgtccactcgggttttcacagcagcacggctcagataggaagccatccagctctcaacgattgccttctgcaaaccctcaggaccgccgaagcgttggatgttgagcagcttgatggcgtcatcgtagatgttcgggatgtaccgaccagagtggcgtgtctgaggcatgatcgaagtggcgtccatgttgccgtactgcgcagggttctcaagggagttctctttgcggacaaagtgatcctcgactaccttggcgtacttcttctcggcctcagtgagctgagccagcttggcccctgtagggtcttcgatagcctcagcgatccggcgatccacatactcacgctgagcctgacggccaccgggtagggtcttcaccgagacgtccttcatggcttcttgttgggcatcgaccatggcgtttagagccacatgatcttgaccacgctcacgctcgatcacgtcagaagccacagcgccaaacttaccgttggacccagagacgccaccagtaggcgaacggaacaactgagcgccaatacctctcagctcctcgtcctcgctacgcagcagcatcaggccaatctcagtcagtccaccgaacttgaacccagcagcggctcgctcaggctccagagaggccatcgctttgatgagcttagggttcagcgggttgctggcagagaggatcgaaccatcaggcagacgcacagcgcccggttcctttgggtggtccatgtactgaatcccgaaggcttcgtcaggggtctcatcggacttccatgccataacggtagggtcatcagcaccagccaaacgagcttgctcacgggcattgatgcggatggttggacccatgaactcgttcggttggctcgactctcggtgcctcgcaaggatgccctcaacggtgtcgtcagagacttccattcgaccctcttgtttgtgggagcgctcaccgtgcatcccgaggatcttttcgaggtactcatcgtccatctcatcgtcaaccttagaggggcgagcggaagccagcatgtcctcatcgactttgacatcgttggactggaggccagcctcaccgtggcgagcaagaaccctttcgagttcctcatcgctcatgtcttctcgcccaggcttaacgagtgacttggcaatccacttgtccaagacagcggccatggtgccaccgatcacagcaccgcctacagcagcggtagcgtagtgaccttcgatcccagtggtcgcctcacggatgccctcaccagccacagcggcaccagatgagaacgtcccctgagccaacacacggccaccaaaggtgcgcagagcggtgcccggaacagggacataggtcagtgggtcagtagcagcgagaacgccaccagcagccagttgaccgccccagccagcggaggtgatggtcttgtcgtgagccatgttctctttggcgagagcgatggcctcaggcagcttgcgcttgtcgtaccgggtgtagtcaccaatgaagtcgaagtattgcgaatcgacaccttcattacggatgtggtcgtagtcctccttggaccactcacggtcgcccgtgtccttcatccactccagtgggtcatgatcctcgacggtgatgttccggtagatctggccggggagcgaggtcttcaaggcagccaacatggcctcagaggagccgtaccatgcgcccttctctgggccgttctgctcgatctccatttgacggaacgacttctcttgggcaggtgcagtggagcccccgatgttcatcccgatgtttccaccgaggctaccttgttcaacggatggtgttgctgagatcccttgggtagcctcttggaactcagcggttagctttggggcatctggaccctcgaaccacttgcgggacggagagtcaccagccacgtccagaaggttcgccatgtactgacgaccctcaggggcgatcttggagaagtcaccacgatccagcgcttgcaactgaggagcgcctaaacggccattcccttggttgtacgcaagggcagccttgaggtagtcccctttgtaggtcttgaggaggtccgcagtgtggcgagcggacgcattgatggacttggcagggtcgaagaagtcctcgtctgtaacgagaccatacgccttaccagtggcacgagtgaactgacccagaccccgaggcccagtcggtgactgagcttgagggttgaagctggactcgttaaagatctttttgtgcaggtagtcatagctcacgccattggcatcagcagcctcacgaatcaaaccatcgtaaggcgtgccagcggccttgacatcagcgtaggttttcttagccatgtgttcctcctaaattggattagagagggccacgaccccctcggataaagtctttgtagagaccttgattgcgttgtgcgtccttcacgtcctcatcgtactcagcagccttgttggccttctgagcttccagttccgcctgacggcgagcgctgtagatgagctggagggattgcttcttgatggtcacgacctcaccagtcaaggtggagatcttgatgtcaccagtgcgggaagcggtgatggtcacaggcgagtcagcccagtacgggtcagcagccttgatacccttgacggtctcctcaacgatggccttaccctgctcccacgagttaacgtcgttcgggtcggccatgagatccttcttgttgatcatcccttggtagccggtctggacatcctcgtcgtcatcacctgcttggaagctaacggtgttcttcgagagccagttggagagcaacttggaggcagccgtagggtcgccagttgcagcgttgaaggcgtcatagagagaacgagccatggtgtccatgtcgttcgggatcgctgagaggtctttgttcttagggtcgctcttgagggcgtcccattggatgttccgttggatcatctcctccttggtcagcttggagttcttcacgtcagccgcaatgaggaccgatgggttaatcccaacgtgcttcatctggttcatcttttcgatgaagccagcgcgctcaggatagagtgacgcaatgagttccggttgctgggcatagacccgtgccagttggtcgatctttggggagtccccgagttcgcccaattgaacagcgccttgccattccttggctgcatcgtcgatcagcgtttggaagcctcgacggaaagggccattctcgtggtcgtccttgaggagctgaccgcgctcaagatccttctgctccacagggatgtccatggcctcgatctgagccagcttcttttgagcgtaggtcgcccagtcggactccttgaactctccagtgttggcatcgacaggcatgtcctgcttagcggtccccaagagggcaccattacggcgagccttgtagcggtcgtcgatggcctgcaagcggttgtccgtctgcattgcctcctcggttgccttaagggtcgcctgagtgtgggccttcatctttgccagcatggcgagcttggtactggtgaccgcctgcttttgctgagtgaagccatcaccatcctgaatccacttattctcggcctcgatccgattgatcatgtcccagccacgagccgggtcagcctgagcctcagccgaagcgagatccagttggaacttctcgaacttcggttggttgcgcttgtaggtggcctcagcggacttggcgatcaggttgtcgtatttctcctgaccgatcacgtcaccgaccttctgctcaatccccatcacggtgatcgtctgatctcggaagttcttgaggaaggtcgatccgtggtccttctggaccgcatcgttgatcacgaggttgactgaatcgaggagcgcttggtccgttgggattgccccagaggatgccttcgatttgaagtaggcagccatctcgatgccagagcccggaccacgcatgaactcagggtcatccagaagaccaccagtgtcgccacgagtgttgaccacagtctgagcaatgtagcgctgggaacgtcgctggtcatgcaagtcgaataggcccgcattacgcttcacgatgtcggcgttaaagccacgctggtagtcaggatcgttagggtcaatacccgcttcctgagcgtaggactgagagaccatctccagacgggtccggcgatactcatccagttcctcacgggattggttgtcgaactcaccagaggcgagcttgttctggatctcggactccacctcaaaggcagccgtccggccagtgtcgtgacgcaggacgttcatcacgtcagggtcatcctgtaggtgcagggttcccgctgcgatagcctcacggcgttgctggagggacatcgaccggatgatcttgtccgactcagcctgagcgttcttcgccttgtcctgagcgtaggtgccataggcattcgccccggccttcacgaagctcgccatggagtcagcgaagccattgttacctacgtcagcgcgttgctgagaggcttggaactggacggtcgcagtggagcccttaaggcgttccttaccgcccatttgggtcgagtctaaagctcgtgcaatttcattagccattaagttcctcctttagctgtaccgttggattgcccagttgccttgttggcgttcatctgacctttcaaggacgacccagcggcgtagccattggcccccgcagagacgatcccaagggcatgactcagacccgaggtcttgatcacttgagcctgacctttgagggccgacttggtgttctcgacgttggcaatctggtttgcaaagatcgacgaatagtcgcgcttgtagttgtcggtgatcgccatcttttgttgactggcctcgacatccaccgagttcgcaatgcgcttcattgagttgcctgatagaccagactccccgatggcagcagccaccgttcctttgttcttgagcgcctgcatgttgacctcagcgagttgcgctcgggcctcctcttggcggtcttgggcagtcagttgcaggttggcgttagccatgttggtctgcttgacttgctctcgggcggtgcgacgttgagcatcctcagcgttaccctcacccttggccttgtccttggcagccatagccccaccgacgaccgcaacagcagccatgccgatgcttactggttcacacatggtgacctcctatagccagaattgacggaaccgacatccggcaggactcatgtggtgttcacgggcgaaggtcgcaccgagagcgttgaggagacggatgtgggcgtgattgtccactgacacgaagttggtcagggattgatggccttgcagcctgagtacgctcagatgccctttaagcatccgatagaactccatacgttcagccttggtcagcaggcccaccacgttggtagtcacaaaccagaggcaatctttggacccacctacagccaccaccagagcgcccttagtgatcaccattgaggtgtcatcgaggcagttcgggatggtgtctcgtggatcgcgcccagccgtgtgggagtggaactcttggaggtcaccgggactgaggtctcgtgcagcagcttcgaggtgccagcgttgtgctttctgtaaaatcataaagatcccccatagggcaatagtgagggtaaataaacccccaccatgccagtcgattagataccgccagaacggcgaatgtagttaccttcccatccgcatccgatgatgttgagtgggttagggtttgcagaactgatcgtcactcgttgtgcctgggcgttgccggtgacagggaacttgaactgcccggtgcccagagccagctcaccgaggaacgtttgagtcccaaggcgaccaccagacatcgggtagacgtactgagtggagccgttgttgacgttgacctcaaacgcgccagagttctcatagttcaaccatgctctccgaagctggagccgaccgatgtcctcagtggaggtggagccatcgtcagcggtctgcttgatgaggaacttggagaactcatattggaactcgtactcacgaccgaagaccacatactcaccagcccggttgcccggaaaggacaagccagaacccgaaggccatggaccttcatgtcgctgcatcacgccttgctggtcaatcgtgtagaacacggagtcgcccgatggcaggccaccgagaatggattcgatgctcacgaagctacggtggaggtcgatgtcataggcaccgatctggatgagcttcttctggtccatgtaggtccggtagggctcctgagcgatgtcgatggtggactgagtgaactcaatgcgctccatcatgatcccctcagggcgatccaacatgaggtacatgtaggagccaatcgagtacgcagcgaggatcttaacgttggtcccgaagttccagtgggagaacgattgttgctggaggatctcgtcgaggtacaggaacttgtagatgtacaggttgcccggttgcccgttactgatcatcgacacgaagttctcggttcctgacccagccagattgaacacggtgttgggcaggtagctcgggacgtgtgcggagacatcctcagcggacttcacgttactcacgtcttggatcgcgtagtaacgcttgagggatgtgtaggaggcccgaggtgcagcgaagtaaacgccacgaccaatcccgaagggacgggcaccgtcagagacatcgaactcagtcgtcaagtccaactcaatggtcttcgaggagagaaccccagcggacgacaatacgaactgggcttggtccgaccacaacagcaactgctcagcgaacggaacggcatacttcaagatactcacacggttatgcgagatcgctacgtcaatcggatcgtcatcgctaagagcgctcacggaggccgggaagaagttgaagtatttagcggtcctcgacatgatcacgttctcgcctgcaatgaagcccagacggttacggaagaagaagatgtcgttgatgcgatcaccaatgaatgacggcattgggttggttccatcgtcaccacactggcgcgtatcccatgtcagcggggtccaatcaaagttgccatcagcggcccggatgagggcgtgaggcatggtcgcactattgaacccagcgatgatccccggcttcgccacttccttccagaccttaccagcgaggctgtattggacccagtagttgtcacctgtgcgagcggactcgccagtgacttccacgaggtatccatcaggggcctgagcgggcaacttgttgaacgtctggacttggtagatgaagccgttcatgagctggtcaccgtagccatccttggtctggagtgaaacaaacccaccggggccgggagcggtgatcatgacccagccggggccagaggttgccgaccagcccgaggcgttgagcgcagtgttgatctgagcggccatcgttgaggcgatccagttggcgtccgtcatgtccacttggttcatgccagcgtaaggctgcccagcaggcaccttctcagcggaaccgttaggcatctggatgttcccgtagacgcccccgttgatgaggatctgcatggtccggccatactgcccaccacggatgttcacaagcccacgagtggtcacgttaggttgtccagcaccagtcagcgtaccgcccaactgagtgacagtcttacggttggtcacgaaggtgtagtcggccacggtgatcaacctcaggtcatcacgagggttcgcacagttggcgtagccgttgtaaccacggaccagatactcattgccagccaagtcatgaaccgtaaggccggacccgaagaacgacacgaagtattgctcggtggagtcccggttgatcatgtggaccagaggcttcacgcccagtgcgccagtgctgtacagacgcttgatgatcttggtcggtggtcgcttctgtagaccctgagtctccgaggaccagccattgatttgcatggcaccttggttggagaaacgcaagatgtccggttgctgcgagatacctcctttgaggttcttgacgctttgcgaaacgagtcccataggccctccttagcggttggtgataccaccgacgaacgcatcgcctgtgatcatgttgaagccaccgaagtccagctcgtactcttggatggacgcccaagcctcagcctcttgttcctgcaaggagccctcgatctcaccagcaccgaagaaccgggtttggaatcgacgagaggacttagcgacgatgtacgagcggaaacactcgggcatctcagagagttgcttgaggcggatcaggtccacggtgattgggttttcaaagacatcagtcttcgcggtgcggtcgtaaacgaatccaccacggttgatgtacagggtgccgcctgaggtggtcatgcgcaggtagtcaggcaggtactcgatgagcttcgagaaggcgtcagggagaaggatcgcgccctcctcaatgttgaacgtccagcccttcgcttggatctcacggttgaccttggagagaatgcgacggcagttcgctacgtcagcgttagggtcaccttcgagggaacttacaggggactcaccgatggcagcgagcatgtcattgacagcatcgagttcgtcatcagagtcgaggaccgattcataggccatgttgatctcctttcgttgaatgaaaaaaaaccccaaggagcccggttaggagccccaaggggttagttggctttaggcagccggggtgaagaccagcgcaccagcagcctcaggacgcaggccaccgtgacccatcgcgtacttgccgatgatctggtcagcttggtactcaggacgacgagcgcgttccagcgccatgtctttcagcttcacggtgccgacagccgaacggtgaaccagcaagccgatcacgttgttctgagctaccttgacatcgccagcagcagtggccgggaaggcgtgcttctggttagtgccgaggtcgtcatcaccagcaccgccagcgaccagatgtgggacttcgataacttcccagcccatcacgttgcggatgttgccggtctctgggtcgatcagtgccgagtagttggcagcgttcggcatcagagcagacaggatcgcgctgtagtcgtcaggggaagtgaagaagcgacggtcgccagcagggacgtagttcttggtgaagcggccacgggccagagtcagacctttcaggatcgctttaccacgagcctcaacgtcaacgaggtcagcagcagcaccgatgttcagaacaacggcagtgcccagaccagcgatgttctcgttggtagcggcaggcaggttgcacaggttcgccatctcggccagtacagcaccgtcagcggccagagccagagcttcgcccagttgtgccgagtattcagcacggacatcgtagtggttcatcgcgtcttcgatgtcgtagatcagaacgtccgaggtcaacagaccgtcgatctggatcactttctcggagtgcttgatgtctttacgcttgtcgtccaggttctcaccagcagcgaggtagtaacctttggtacgacccataacagggaacgaagcggacttaccattctggatggtacgaaccatatgcttgtccatggtcacggagcgacggacgaaagccgtcaggacttcgccaccgaacagcttaaggaagttcgccagtttgtcagcagggttctggcctttgccttggttcgcgccgagttgttgaccgccattcatgttcgccatgtattagttctcctttgtgaaattcttaagggcgcaagagatcctccgaaggaatcggataggtatctctcgcaatagtgagggtttattaattaccagttggtgcgcagcactcgggcttcgacttgggcacggtaagatgggtcggtagcgtaacgggagtctcccatcgcctttaccatctcggcctgagacgcatagccttgtggaccttgaggggcctgtttaggaccacttgcaggggcacgcttagtgacgctacgttccggtgtcttgccgaacttcttggtgcggctcgccatgcccagattgatcagcgtcttgatggacgcaaggtcttggttctggatggctcgctccaatgcttcaacagcatcaggggagttggccgtcatgtgagccacgatggctttgaacttctcgggaccaccagcgtattgctggatctgggccacataggtttgagccagtgcttcttgaccgctgataaacgacttcacgaagccacggctgtagccaaccttctccagcgcctttaaggacgcctcagagagtttgttgtcagcttcatactcggcctcgatctggtcagcgacctcttgtggcaggcccgctttgatcgcttgagcgcgcatctgagtgaatccatcagcgtactcatcgacggcctcagaggcttcgatcaggtcagcgtcaggttcgcccagagggacgaactcatcggagtcagcaccttcgtcagtgccctcctcgttcgtcaattccagctcttgagagttgtcctcgccggtatccagttgcagctcgttggagccttcttcggcgtcctcgtagtgcatctcgatggagtcatcgccatcacgaacagacacgggcattgccagcatcgcttgctcatgctcggtgatgttggtagtggtcatcacagcgctattcacgccgaagtgtgcatagacgtcagcttgggattcgttgctcattgggtctcctttagaaaatggagagacacacgcctcgggcactatccgaggtttcccagatgtacttgcttggcagaacgtgtgtctcgcaatagtgagggtttattaaatcggggccgcttcgatgcccgtagtttccatagcgccttggatggcctctggacttgcggtcgcttgttgagcgagaccctgaccgatgccagcagcagcgttgaggccaccttgcttgagcatctcttgggattggagctgagccttctcggcctcagtgagcagcagaccggacgtgtcgatgcctatagcgttcgccagtctcaacttgatgttgctcatgttgaggtctggatcagcctgtagctgactcacgttagccattgcgctcaagaactgattgagcttgtccaagtcctgaccacgacccagtgcctcgacaccagtgctgacagtcggctcaacggcctccttcggcatgtctgggatctgcgaggttgcctgtagttggttcaacaggatgcggacgattgggagttggagttcctgagagagaatcgaatagacgcccccaagggtgtcctcaagttcactcgccacatagcggatctcctcggcagtcacacgttcgcccttgcgttgtaccgcagagttcaacatgaagacgtaggagaggcgttgctcaatggcatcagcgacagacttagcgactgtgaagtcagcggtcttctccaactggaggaactcgatgtcggacttcttaccggcaacaaagtcaccagtctgagccttcaccaaacgacgaacctgagtgacaccgttagggttcaccagtccgatcaccttcgaggcgaccatcgagaacttgatcatggcctcatggagagactcaagggagttcaggtcaccgaggtattcctcgacatgagagcggccataatgctcgccatcacgtttggtccagcgcacagcgatccacgggcaggcatccagaggatactgaccttcggacccatcgacttcgacaccatccacttcctgataagaagcgaactcaccagactcatcgtcaagataaacatgggtgtagacctcgatctcttggtcgggcttgcgctcgccatcagcgccaagagagttgcgaacgtcctcagggagagccgcaaaggcgaccttatccacggtgacgatctgtaagacgttcccgaaggcatcacgctggaccacatggttgtggagcgtgtagagcttcatcgggttgtacgcagacgacgatgcgtctggtggtggcaggtagatcagagcggaccctgcaagggccaactgacggatcagctcaaagagcgtcacacggtacgagttggcttccatgtaggacatcaggattcgctcaaccatgcccaagccttgttccacgacagccagttgcgaagggtcggagaccagttgcttcgcttgccactcggacaccttgagcttcatccagctttgcagcgggaatagagccagcatgaccttggcagacaggttgttgagcccacgagcgcccactgcttgccacggagtggagtagtcagtagaggcgttgtcggagtctttagggaacagcgaggggatggtgaccttcgcgcagttttcagcacgggtctcgtagggaactcggtcgtttttcagccgttcgtaaacagcctttgcgccctcctcagcgagcccggtgcgagttgtagtcgccacgggtcacctccttggttagatgttgatgccagtaccagcggaacgagccacgctcagaccacgtttaccacgcgcacgggcagccttcttggcagcctcagtgtcagcatcatcggagccctcagtggtatccttcggggcctccacgacagccgctgagacaggcgcaggggcagccacaggggtcggtgcagcaggggcttcgactacctgagcaggtgcatcattaccgccagttgcttccttgatcacgccagccgggtcagcgactttaacgacagccttggtgaccttcttgacgacctttttaattttcttgcccatggatgttctccttcagttgtttgtaattgatctcgtagcgacccacgcctaagcgcttcgtgtacgccacggtcttgtagccagcattggaggccagcctaacgattgcccgaaggatcattcgacccacggggccacggtggtccgggtgaacccagtgccattgcgttccgaggcactcacctacatggtcatcctcatcattgacgaccacagcgaaccccacgagcttcccttgcgggtctctcacggtgatctctatgcgttcgtcaagttcttcggttgaccggcagatacgctcgtagcattcgactctggacccgccccacgtcagctcagtgagttcctcaaggatgtcgctcagcacctcacggaagcaggccgggtgaccttccttctggacatgcgcagccaggttcacttagtgaccttcttgagagccttcttgatggatgcagcaggcttggacttcttgatggtcccggtgcccgtatcagcagcgacagcatcagacgaaccatcgccagtgtcctttgtggaaacatcggacttcttgaccttgagaccatcgagaccctcatcgctggaggtgtcatcgtcctcggttgagccgaagtccacgcctttaggttcctcaatgagaaccggctcaggcgctttcacagcatcagggttggtctttggggtcttgaccttggatttaaaacacatggtcattcctccttgtttagttgagcctcctgcatcagctccacgatctcagtcgccccatggcatccgtcaatgaagcccatgatgtactgctcggagaaccccgctttgcggagatcatcgacagcaccagtggagatcagataggaagcgttgagacggacgttgagatagtcggcagatgcgggagagatgtcagggatgtcatccgggttttggatgtagtgttggatctgcttgagcaataggactccttaagggaacactgggctccctctcgcaatagtgagggtaaattagggacgccagaggatgggcttcatggtctccatatcgaagtccgaagcgcggcagatgcgagccacttgggcttggaccaccagctcctcctcagtcattccctgcttggcagcgagcgacaccatgcagtcccagagggactcgccatcaggctcacgggaagtccagaacggaacctcctcgcctttgcgtttgccggacttcatgaccttcacgtcttggaagtagaacttcggagactggagccaatccatcaggccaccatcgaactcgccaccgactcccggtacgccaccgtaaccatccgtggtgtcgcccttgagggtctgatagaagtggtgcaggtcagaggttgcctcatcgttcttgatgagttcctgctcggtcagccagaagaagtatcccggcaccgtgttgaagtctttgtcacagctcacgccgatcacacggtcacacttaacgatgctcgggtcagtcatcaggacgccacaaacatcgtcaccttcgacaccgtgccacttgagggacatgtcaccgtagtgcgccatgatctcatcgcagaacttgcggtagcccacaggcttacgcttgcccttacggttggccttataggtctcaaggacatccttacgccagttgtcgtcaccgctcaggatgcagatgtccacgaactcgtacttgtcctcagtgagcttgaacttgcgcttgagttgtgcggcgatgttcgccttgatggtcttgatggtgccgaacagaatgtcacgggctttcttgtgatcgcagaacagggtccatacgtcttcgccccagtcctgctcctcctcagcagcggacatcgctgagaagatgaggtagtccatatcatgggcgaggcccactttcagtttactcaaacggcacctccatattgtgcgaggaagtcttggccggaagtggtcaaggtccagagacccatgttcttaccggcagttgataggcacgagatgtggcctcgggatgaagcctcgttgaccagcgcaatgcgggaacgaacgaagtcgctttgatacgacctcgcttgctttttgatttcccagagaacctttaggtactcattcataccgtctcagtccaacgaggaccgggctcacggatgccagtgcgcttgttgtcgcagccagcgttagtgttccgctcggccagcacgcagttggtctcaatgcagccctgacaggaacgcttaggtggggcctcataggtcaccttgatgcagcccagtcgggcggtcgattcgttgccggtgatttcctcgaccagttccttgcggatcagctcacggatgccagcacggtagatcagctccatcacttgctcagtggtacggtcaccacggaacagctcagcgcggaacttggtctcacccttgagcttgtcgatctcctcagcggggatcttacgggcctcctcacgggtttcgtcgaaggctttcagggtctcggtctttaccacgatggtcatcgggaaggacacgttcagtttcagagtcatgctcataaggatctccttagtgacactcgcgccacgttgggccgatcttggaatcggtagccagtgggcagcggaatttgaatgattcgcctaccagtcggatggcctcgttggagacctttgcgaccagctcagcgatttcttggttgcggcaggcaatctggagttcgtcgtgaacccatgccatgaagcagaagtcaccggggttgccatcgtcgtcgtaccagccatgaacaaggccatgctcctcgacgagaatgcgttccacctcaacaacccacttcttgcacacaagcgcaccagcggactggagcagcgagttgagcgcggagtgaggggagcggacatggatctttcggccatcgagacctttgatccaacggcgcttccatttgatgtcgtacttcttggtgacgttgttgtacttctgctcggagatcagttgctcctcaagggctcccctcaggccagagatggccggggtgttctccatgaacgccttcttgagtgccttgccttccttcttgccaccaccaacgaacgaccccacgagaccatcaccagcgccatagaggaacgcatagatgaacgtcttcgcggtgtcccggtaggcgtcatgttcatggttctctttgtcacggattaggccaggaggagcgataccagcagcgagcgcattgacccagtggatgtcaccgttcaacacggtctcggcatacgagccttcgtcgaatggcgcaccgaagtgacccagacagcgcagctcaaggccagaggcgtcagtccctaactggacggcgttctcccagcccttcttgagcttcctcgcaaagaccgccccaaagagcgcacggcacgcaggtccatacttcttcttggcgctgggcacttggcccatgttcgggtggctatgggtcgcacggcctgttacagccccgttggggttcactgagccatggatgcagccatcctcacggacgtatcgcagccacgctttgtcgccctcagagagcatcccaatgaccttggtgacctccatgaactcgcgcacaaggttgatgcacgcttgcttcttagggtcagccacacggacgaactcaagggtctcatcgtccatcttggcagcgcccgtgttggtcagctcggtcggaacccagccagcatcacggagaactttctcaaggtgcgcccgagatccggggttgaacgtgaccagttcgattggcgtgtaagggcagccctcgaaggtctctcgggtgtccttcttgccgctcttgaggaacacgccaccgatcttgggatagaccaccttcggcatgacacggccatcagaccagtagtcgattggtgcgccagtcttcgggttgaggaactgcgacttaccacctttcggagaccaccacgacccaaaggtctggatgagttccacgaggagatcgctacgacgacccgccagttcacaatagagcttctcagctccctcgatgtcgaaggggaagccattgcgttccatctgggccagcgaccacgcagccgcatgttccaagcggatggcctcaatggcctcgccttgatcgttgaagtagtgcaggtcggagatgatcttgcggaacaacttcgaggtaacccgaacgtcctgctcacagtagtcctccatggactcggagcattccagccactccataccgtcaacgtagacgccaccatcgttctcaagctggaccttgaagtcgtgcttgtactcacccttcatctcgcccagacgatagccccacgcctcaagggagtgagagccaaacatcttgccgggaaggatgcccgaacgcatgagacccgagtcacgatcacccacgttggagtaaaccagacgggtcatcacgagggtgtccatcacgcgcttccttgggatgttcaaacgcttaccgaagtagagacgcttgagcttgtcgaggaccgggatgtcgtacttgatgaagttgtgcccaacgatcataccgtcaggcttggcagcttcggcctcaagggcagcgatgtactccttgaaggtggactcgttgtaccgaacatattgcccggtgaaatagtcctgaatagtggcgcagtggaaccgagtgacggactcatagagcccgttcgtttcgatgtcagagatgagcatgaggccctccttagttggagaaggcgacagcgctcaaaggcagccatacgacttctgggcgatacgggcgcacgttgaagtggaacagcacggcatagccggtgtactcctcggagcggtgatagcggatctcgatggcgcggaacaacttgccagcgaagtgaggaccaaaggcgaatgacgccagttggctattggccgggatcttggcgcattgaacgcggaagtccttgccgaccattggtgcaacgaggtgccagttcggaccccttgggtcgtccttaatgcgggccttgatgtcagcgtcaaccttctcagcgatcatcttgttgagcgcctcaaggattgggtccatcgggtttactggagcttcccaatgtgggtgatgcccagccttctcgatgtacgagtagcccagcttttcgagtacctcagcggcctgctcaccacgtttgatgaacttgcgaacgtcagaaccattcatgtgtattcccccctgtagcattgatgtgtgaactcactaaaaggcccctcagagagaggcccttggatcagctcacgcgcttgatgtcttcgtgtttccacttagcttgcacacgttgatcgacggtggtttgcagggcgttttgagcagccgtaatggcagccttcaaggacgcttcacgagccaccaaacgagcgtgacgcttctcttgaatgcggccagccagagtgatcaggaaagttacgaggtcgaagttcttcatggtttggttctcctttaaaagtcaggttcttgctggtctgcccatgcagcatcagcggcgtcagttgcatcttggtcaggtctccagccctcaggcttcgctaccaatcgaccagtccgcttgtcgtattccatgtagccagccacgcccgtctcgcccgtgaatcgacacttgaggagtcggaacaggatgaggttagggttggcaccttgttggtttcgctctacagcgatgatggtgtcgctcagttgacgcagaccaccggaccctcgcaggtcggtagcggtgacaggtcggccttcctcgtgaggtttacctttgtccgggttcttcaagtggcagataacgaagacgacaacgttcttggtcttggcgaagctcttgagcttggtcatgagccggtcgatcatcttgcgttcatcgttctcaccgtccatcgcagagaccacgattgagatgtggtccagtacgatcaccttgcagccgttgacttcgaccatgtacgccagtcgcgccaataggcgatcctcagcggactcagcgaaggcgtcatagaggtgcagcttgtcgctctcgaagatctcgtcgaacgccttgtcgaacatctcctcggtggtctcatcggggttctgacgaactcgtgaccccatgtggagccctacgatgtcctgtacggtttcctcaacggcctcctccagcatcgccacgcctacgggaatcccgcagtcattgaacaggttgtaagtgttctggcgaacgaaggtggacttgcctgagccggacccagaggtgaccagaacgacctcaccttcgcggatgtccttggtcatcttgcggagttcgtaaggagccacgagcggataactcgggactgctttcttctccttgatgcgggccttaagggacttcgcagagaccactccatccggtacgaatggggcagcgttccacatggcgtccatcacagctttggcctgggagttctggagacactcgttcgggtctttgaaaggcaggactgcgatcttgaccttgcccggtgggagaacctcagcggcttcccttgaggcaatccgtccgggctcatccatgtcaaacatgaggatgatctcgtcgaactgatcgaagtaggcgtagttggccgcacaggtcgccttggcagccttcgagccatgcccaatggacacgaccggatacttaccaccttggatctgggccaccgtcaggcagtcgatctcaccctcggtgacgacgatcttgcgaccaccgttccacaggtgccgaccgaacagagcgtccttgtcatgcttgcccttggtaaagaagtccttgttggcttgacggcacttctgcgacttgaggttgccctcggtgtcgtagtagttggctatctgtaccgggacttccttaccctcgtgaggcgagaacgccttgccgatccagtaaccatagaggcggcagattggctcctgtaggaacctcttagggagcgccgagaagtagcccccagcctcgcccattgagagcgtgccgtcagctttgagcctcggtgtgaactccccacgctccttcccatcgggtgccttataggcagtctcagggggacacgcaaagcagtattggtgaccatcagagaacagtgagtttgcatccgacgacccacattcctcacacgggatatgcgcaaggaaaacgctttcttcgcgttcctcatgcgacgacatcggccacctcgatctcatcgacgtaacgtccatcacgcatcggtgccttgtggatcaggtccagccacttggcttccatcttttcagcacgggagccacgagcgtcctctcgcagttgaaccagattggtccaagcgtgagcgcccatgaagcggatggttgccccttcgatgcccctttggatgcccgagatggcgaactgattgaggttgtagtcgaacttctggatggcctcggtgacacactcgacctcgtaaagaatcacgtcgatctcgcagccttcgattttccagacaccttgcagccgatcagagtcggagccggtgtggtacttggggaacttgtggtaggtgtagccaccttcatcgagcgctctggaaacagtctccgggtcggtgcccgcgcaaatgatgtcgatgtctttaggctcaaccgagaagaacaggtcacgggcacagccaccagcgataatcgcgccgatgccacggtcaatgagatgctcacaaaggtcgaacccaccttgcagtaaggaacgattcataatgacctcctaaagtcaacgtttaaaaacaacaaagccccaccaaccgaagtcagtgaggccgtgtcgcaacagtgagggtttattaaatcccttgagttttcagccactcggccacgtcgaaggacgggcaggctttacccgagtcgaggtcgcggtgacccacgatcttggcttgcggataggtgcgcttgtgagcgatcagcagcagcttgagcgagttgaattgctcaggcgtgaagttgttctctggggcgcccttggcgttgatcccaccaacgaggcagatgcccagcgaggtggagttgtagcccttggcgtgtgacccaatgacgtcatgagggcgaccatcctcgacagtgccgttacggcgaatgacgaagtgatagccaacgtccagccagccttgttgaacatgccactggcggatctctcgaacgccgatgtccatggtcggtttggttgccgcgcaatggaccacgagcagggtcgtacttgggcgtttcttgaaagcagcctttggcatcatttacctcctttcggatggagtatccccgctgggatctccttacgtttctcctgtagccatgctttaggaatgagtttgtctgcgaacatgatcccgtgcttcgtgcagaagtcggcgtagctcgttggggagcccttatagatcttgctcttggagttcgagaagaccagacggatgtcaaggtcagggtattgctcacggatcagcagatgctttttccggtcgtccacttcccatatccctttggtctccacgatgatcccgttacgcagaacgaagtcaggtgtgtacttggcctcacgggccggaacgacgtacttaatgtggtactgctcgaagtcgaaagggactccgagcttgtccatgtgagccgcgttgcggtcttcaaggccggatcgaaaagcgcctgtacgagcgcccttcgggccagcgtagccagccatcagaagtccgaggcagcgtcaggaatgacctcgccagcatggccttggtcttcgtgatcgtcccagctttcttcacgctctggagcgacgtagccttcttcggtttcgtcagcccagtcgtcattgccagcagcgtactcgaccagtttgatcagcatcacgctatccagttgcagcttgaccgaggcaccgacaacggcaccgaaggtgtaggcgaacatggagaagcgaaccttcaactcggaaccaccagagatcgcaggaacagcgtcgatgcgcttacccttggcgtccacgaccttcaaggtcagcggcttggtctctttggtttccttgtcttggtacgaggcgtagctggagaacttgaacgtcacggtgccatcgtcgttctcgaagaacggcaggtcgccctcatagggttccagcagtttcttgccacgggccagcttggcggtcagcgatgcgcggttcttctcgaagtcctcgcagattgccgcgtagctttgttcctgcatacgaacgatgcggtcgatgattggctgggcatcagcacggctcacggtcaggttgaccttatagacgccacgagggttgccgaagcctttctctgggttgccgtagtccggcttttggatcgagcagtaaggttcagctacgcctttcggggtaaagaagaactgcttggtggattttgccatcgggattatctcctatgaaagtgggaaggtaggtgtctcgcaacagtgagggtttattcagtacgagagggattcacgctcggtgaacagggtctgcttgaaggtctcaatgaccgggatcagcgtcaccttggtcatcgcatggacgacctcacggaagttgttcttgaggaactccttggagaaccgccagcagccgtgtttgaagtggtgcagctccttgccttccagctcagcggtcacgatggcgcgctcaatgagcagcccttcgaccaactgacgttgatgggcgtcaaggatgtggatgtagaccacgccagccatccccgcgtgcttggtcacggtgaagttctggatgtggaggaagccatcaggcatcgagcgggtgttgccttgggccaggttcattgagtgacctccgggcgaatgcgccgaacgttgtcttcaccgtactcaaggtcagcagcttcgagcgcttcctcaatggtgcggccatacattggcacctcttggacctccttgcggtactccacggtgacgaggaacttcttcattttctggtcttgcttaggcatgagtaattactccttgagttctgagttggtcgatcatctccgaggcgtggccccacttgttcaccacaacggcgtccatttggaagtcacgcagttcaatgtcagtagcgtgtagcggctggtcatccacagcagggatcgcccagtctcgggagagacgaacgaggtgcgcttggcggatgctcagtgctgcatattcgttggcttgacgcatgtcagtgacgaccacgagggcatccttgggagccttcttgatctccttgagaccctccagcagccacacgtccgggttctgcttatagttgcgacggaagccggtgccgtattgctggaggtgccagcgaggtgtccttgggatctcgatgtcgaggatctggggctcattcagcagccaatccttgtactcgctctcagggatcgcctcgattgccaactcctcgaactgagcgtccttgaagtcggtgtgcatgtggctctccataacgatgcgttggcattcgtcgagggccagcatgtggctgcattgcttcttgaggacatccccaaaggcgacccggtagacccggtagccctcgatcatcagaagctcgcacagggtgtctttgccgctacgaccacgctcagaagtcagggcgatgatgtcagtcattgacgatctccttgatcttggtccagaggttcttgaagaacgtcttggtgcgctgccagaagtcggcctttggcgctggtggtttaggtggacggatgttgaaccgggcgcagttgcgttgacggtcgatgttcgattggtgcagacggtaggcgaacgaacggtctttaacgggcatcgtttggatctccttttggtggttggttgggtgtctcgcaacagtgagggtttattaatcctcgtcgtcgtagaggcgctccatgggagtccggtcaggctcgaagccagctataaggatggcgaaggtgatcacaacgaaaactatcatgatgaactgggtcatagatttcccctattcagacaggcacaaaaaagccccaccgaccgaagtcgatgaggctcgtttagttactctttgatgagtggatcgctgataccacggaactcgtcgaagctcgggtgacgcatcgacccatcagggtagcgttccatgcaggtcactcggaccatgtggtggtggtacgggttctcagcgtcaaccaatgagctgcccatcccgtagatgatcgactcgatgtcctcaacgtcataaccgttgtggtccatcactttcttggtgaactcctccatctgggccttactgatcttgcaagcgttgaccacatggccggactcaagttgaacctcgaagccgatcaccttgccctcgttggctttacccttcgagccccagaccagaccaaccaccttgccgtcctcgttgttgctcggcaccttcttccaccagccgttgcacttcgagcggcgatagaagcccatcggatctttgaccaccagaccctcctccttacgctcgcgcaccgaggtatagagctggaccagcgagagtggcggttggagctttacggtgatctcgttgccttcctcgtcgaagccttcacgctcaaccactggcatggtctccactgagaagacctcgtaggactcagcgacgatccattggatctctgggaagtattccttgagcttggctacctgatactcaacatggatcttacggacgcactggaagacctcgtattcctcaccgctcagcacaacgtccattggtacgatgtcgaagacgtagacccggatgcggctcagtgggatcgactcctctttacggcgcagggtgcccgaggtggtcttgcagggaacctcacggtcatccatgtcggtcaggaccaactcagcgtccaacatgaacccttgagggaacatcccctcgcctttgttctcgttgaagaagtcagcccagcgagggtcggtgtccagaggaccatgagatggcccgaaggccgggaagcgcttgccctcacgggacaaccactcgacttcccaaccgtggtcatgcttggtctcgatcaggttcacgcacaggttcaaacgaacgccgtccttcttgacatcagcgatcaggtaggactcatccagaacagcctcgacagccttctcgttgtagtcggttgggcggaatggcttggtgttcaggataacggcttcgactttggacatggggttccccttagttggattcggtagtggtggttttaggcttgcgaggagcgcgggttttcttcaccggctcagtcacaggttcagcctgggcctcatcgacgatcatcacgtcagccttgacgccttgcagttggctcgaagggaccgcgctcacgtcagtcacctcagcgggcttcttgaggatgttcatcagggtcttgaagtgcgcctcaacggagcggatggtcacagcctcggcaccgacccgaagggcttcgatgcgagtctcaaggtcgccactgagaaagcggttgtccatcagctcttgaacgtcatagccagtcttggcggtggtcgtaacgtcaccgatggtggtggaggtttcgatcaggatcaggtcgtcaactttggacgaggtggcggtaacgataacttgcattgggatctcctaaggttgggaattagtaggcagcgttgccggtgcagattggggtccactctacgcgaccaccacggacgggcttgttgcgcttgcccttcttggtgcggatggcttccatctcggagtcatcacgcatggtacgtttggtggtcttaacgaagttctgagcggcgttcataattggtttccttatgcgaaggcgaagtcggatttgaggatgtcgcggatgttgagcgttcccatctttggaagctcaggcatcttgtccagttggctctcgtgtagttgctccatgaattgctcacggaagtcagccagcacgttgttgttctcgtaggtttcgaccatggtctctcggactgcccggaacatcgcgccagctttggcagggatggtgccgaacgagtcgtggatcagggcgaagaatcgaatcccgtggttgtcgtaaccgtgtacgactgtcttgcgaaggtgcgagccgtcttggctgtgaacaaagttcggagagatacccgactcttgcttccttgcgttgatcttgctggacccgttgtcgcgcatcatcacggtggcttggatgcgaacgtccccgaggaacatgaggtcgattcggcgcgttgggttgatcgtatattgctgccataccgggaacccatcaggggtcgtccagtagactggcatggcaggcttgaggatctctttggtcttcttgcacttgacctcagaggccagcagcttggcggccttctgtagccagttcattgcttccacagcggcgaccacaacaacactcaccgagtcccagattttgccagccatgtatcggctcgcttcaccggggcttgtgaacatgtggccctcatcgttgtcgatggccttctttacgatgtcctctcggacttgatcagcgaacccgtaggctttcgacccgtaggccagcgtcattacagaccgcttggtgaccttacgagacatcccgtaagtgagccacgcaatggcgagggtcttagtgccgagacgtttaacatcgcggatctctccagtgacctcatcgacgagagtttcgatccagtcgtccgtcccgtacttgaggtcatattgcagagcgatctcgacttcatcagagacgatcttgtagatgtcttgaacggagtccgaagggattaggttgacagcacgcccgccacgttcatctcgaagcatcgcggaaaagtgctggatgccagaacaggaaccatcgaacgcaaggggtagggcactgacgtgtgcagcgccattagctttaacgccagcccactcaaagcagaaagcgaggaagcagaatggggagtccatggacatccattcggtgacgttgaggggatcgttggcaatcgccaagataagttcttcatggtctcggacccattgtttacgttcaggaaagggcaccttatcgacgcccgcagtgttggccccatgaatcatgagccactcgattccctcctcacctacaggttccccatgggcagcctgcaagatccctttggtcatatcgttagactgagggttgaaggcagggaccgcgtagacccggccacgccaatcgaggttgtacgggaagtagatcgcatcgtactcagcaaacttgttggcttgctccagtccgaactcgtaggccaatcgccgggatacccttgcggcgtccttacggtagaccccagcggcctccttcttccatgccttgagggcgtctgggttggtgtcgatgtcgtggggtttcagtggcagctcttggcgttccgttgtggggaactccttgatctgtacgttcttccattccatcaccgcattggcgacctcaaggacgcgcttgttgactgcccaagcggttgactgtgcgatgttgactgcccggtaaaccgcaggcatctcgacatcccggtagcgctctcgggcttgcttaccgttgagccggatgaaggtcagaggcttgcgacccttggcccagtagccaccaccttgcagacccttccacggtttaggcggaacgatgcagggttggtactgaggcgtgataccggccagtgcgaaggcccggttctggatcttgtcagcccattcgtccttgaggaacacatactcgccatcgttcttcttgtccccagcgtgatcacggcgaacctcgatcagttgggtcgattcgatcaacagctccagcattcggatgcccatgtggaagcggacatctgagtcagcgacgttccagtcaacccatggttgagccagctcgcctttctgtagcatcgactcctcgacccgctccatgtacgccttcttgtaggtcataccgttgcgcttagcgagagccggggcgatggctcgcttgaagtgttcagcctcaaggactcggatgcgaccaaagcgcgcttcgtcttcgagggctccaccgaccacgatgctcatctcggtcaccgttggggcaccattacggcgctgggcgatcatgttgagaacgtagcggatggtcacagcggccatcgtgtccgggttcatttgctgtgcagcggcgaagctcacatgtttacgaccacgacccttgttggcttggtggtcgatccatgcggtgatcgcagcggacatcttagggaccagtgtgcccagcagcggctgagcggcgatgttgttggagaactcaccgcgctccatctggcgctccatctggcgatgaaagcgttcctctccaagcgtgtacgcttcgtgttccaagcgcagttgctcagcggccagttcggggccgtagatgctggagagttgattgaaggcgaatgaggatgttgcgatgtcagcgaagtcgtgacgctcggggatcattctttaagatgctctatgagatatagttgtcttatagaattgctctataaggtttatctcagagggatctttaagatgtctttaaggtgatcttttaggcaggaaccctctgaggtgtctcgcaacagtgagggtttattaatccagccttacttaaccacctcgatccggccatgaacatcggccatcttgtagacaaatgtcttgagttcgaggtcatcgttccacttcgtgatagcggagtaatacttgctgatctggtcgcgcagttcggccacttcggagtcttcaaggagaccctcaggcttgaccgcatcaccatgggtggtctcaatgacatcgacccattcctctttgcgccaccagagcatcccggtgactcgcagctcttgccgcttgagggtcacagcaggccggtaggttcgctctaagcgctggtgccgctccagcttccacttggcatcgcattgaggctcatggagcagctcagggcttcgtgaccactgcttgatcgtcagtaggtcatcagtgatggcaactcccaggctgacaacgtgacgaccacaaggcccaaggcccagctcaaaggtcagctctttggccttgacgagcccgtaggtgtttggatcgacccaagaggcgcggaacttgatgagcttggcgcgctgggtgtagtcggacggtggcagtggcagcatggacgggcgtttcgggaagccacgcatctcagaagcctccccggtagcagcgagtgaagtcgccttgatcgctgtagcgcaggccggggcacagcataccgcccaccacttggcgagcttccatggcactcaggaacgcctcagtgaagtccttgcggcgtccgtaccagtagccaaaggcgtccttcccggtgcgaacggtgttctttgaggtgatgatttgttggtcaatgagccccggctttcgaggctggtaattcgtgtgcatcacttaacttcactccagtggaccagtagttgtcggcagccttcggtgacaggcaggccgtagtgcagggtcgttttgcccttgaagaacatgccccagccgggttcgttctgagggaccatcacgtcagggaagaaaggcccttgagcagccatcgtgccgccccctacatggtcatcgttgagtgccactaccagagtgacgtcagagtcccggtcggtgtgccagtgacctcgtggggtctctgagggctcatagcgggcagcctgtacgctggtcaggttctcaggctcaaggttgaacagcaccttggcgtaggcgatcccagcgtcagcccagaaggaccggaagacctcgaacagcaccttgtgttcatcctgcaaggtcacctcagggatctgcgcctcaaggggctcctcaaggttgggctcgaagacgaacttgctcatctcgtgcttgatgtcgcggcagtagcccggatgcaggtaggcgaccgagtagacccccggtgcatggcagaccacgcaatcgtcaaggaacttctgccaactgctcgtgtcagagaacttgctcgggttgatcccgccgttgtcctcagcgtatgcggccatctctttgagggtctcaagatgctcacgcagaaggggatggtacttgtcaaccgatgcgatgcccgtggtggccttagtgagaacggtactcatccgaacacccccagtgcgacgaggccatgcccagcaccaccaccaaccgcaagcgcagtcaagtacccaagggtctctttaagtgctgatttccaacgattttttgcaggtttgggcttgctttcagcttccagttctgcatcacgacgacgagcggtcaacaatggatgctcggaacgtgtgtataattcgctcaacaaccccgagaaggctcgctcatgctcctcggaccagacgaagcaggcttgcaagatcaggctgccaacgtcttgaccagaaccagcaaggaactggaaggtgtagcccccgaagtcgtcgggttttacgtccacacggagccagcgttgcccgtgccggttctccacatagtgggcgtaaccatcagagagagcgccacgcatagcagcgatgagacgttcagcaaatgcagccgaagtgaagttagtgcggttgtagcgttgcataattcaaagacctaagaagtgcggtaaatggagcggtacagaatgcccacctttgcgctgttatcgacgcgaaggcaggctcttattgaccatcgttgagaggtacttatttgcccggtggcaacatgccctcgattggcttgcccgattgttgctgaatcagcaggtccagcttgaggcgttccagtgcagcggcctcgtcgcgttgcttctgctcgtcttcaaggcgttgcttttcggccttctcctcgttgctggagttgttccaccagttcgccagagaggtgcccgcaaaggagcccgctacggtactcatgaagccaccagagccaccgcccatggccgctggagccgattgatggaccacagtggtacggttgacggtgacgttctggacgacccgaggagcaggcttgtaggagctggtacgcggtgcgctgtaagagcgggatgcgctggagctactcgaccgactacccgagaaacctcgtgcctcagcgtcattcgcatggatggccccgagggcgatcacggtagcgaacagagcgaacaggcagatgtttttg

SEQ ID NO: 19 - DNA, 97280 bp, unidentified
  misc_feature 1..11: note = bacteriophages nucleic acid sequence
  source 1..97280: mol_type = genomic DNA
gatttggtgcgggattacgaactcgaatcgtaacttactgggtggaagccagtcgtgctaaccgttaacactaatcacgcatatttggaagcctgtagtggagttaaaccactctgttgccgctttgcaggcggtagcctatgtcgctcagccaacaggccatatttggtgccctcagagggattcgaacccacactgtactgattctaagtcagctgtctcctaccagttggactacaagggcataattggggtgatctggagattcgaactccaacaaccgggtcacaaccggaagactgtatccagacagcacgggaccactactacatcttgaatctttaaatccaatcttcctctcggaggtggacttcttgaagtgcttctttaaatgattgcttatccatcaacttacacttccagttgagatgatcacagcatgggcaacgtttaccgttacgcttggtgatcgccaaccttggtcctctgattctaactttcatttaacgctcctataatttggtggaccgtcggggagtcaaaccccgcctccctgcgtgcaaggcaggtgaactatcgaaattcttacagcccaaattggtcagtcccggaggttacgctcctccgccctaagcttccaaagctaatacgctactattacgccagagactgattaattcctttgtaccatcctaactggatggctgtgtggcgtctgtgacaattagcacatagaacgcgacacttcgcaatttctgaactgatcttctcaagagagtaggtcgccagttcagccactgccataaactttgttgagcgatcaatgtgatcaaactctagaacgactggatcagattctccacattcaatacatggatggtctttcaagtagtcccatataaactgtcgagccactacaacccgttctgcctgtaacgacaacttctgctgcctagcttcaggggttcttttcctgtggtactctcgatcatatgcctgcttgcatgggcgacagatagaacgcttctgtccgaagtcctcataatctgtgctacatgtcttacagtgccgcatacaatctcctaattggtgggtcatctaggactcgaacctaggatgtatcattgtgcggggttacagcccgtggtcttcgccgctcgacccaatgacccttaaattggctggtactataggactcgaacctatcatctcttggttaacagccaaggacccacgcccggtgagatcagtaccaataaaatctgatagagactatatttagacagcacactctatctggctgtacccgtggggagcacggtgttctttgaatcttttgcttcgttatgtggtgattgtagcacgattaccgtatctgtcaacccctattacaaaacttttttgcaaaccatcgacacatcagaggcagcaatcgtaatggtgttcgttgtgctgttagcagacaaacccacttgaggcgtcaacacgacagggctactgcctgtggtgatccgtcctaccatcgacgcatgaagcttcacagctgcaacacctacaacagccgatccagatgccaaggccgtgcttccgtacaagaagcctgtacgccatggagccgtacctgaagcgttggtgaaggctatcctgtagtcaatctgtgcagaggcaccacctgtgaggttggcaaatccgaccttcagtcccacgcttgtgttgactgctgtatacatgagacgcaagtctacgtcataaacagagttggcgtcaagcgttaccgttgtagatggcaggttggtcattgtgcttgaggtcagtgtgatatcactggttccttggctccacaacgttggtagagggctgtcatacgaaacaaagaggatacgtacaggcgtcactccaccaatcaacagcgtggctgtgaggatggtcatagacgatccctgagccttcagtcctgtggctgtgccattggcaaacatctgtctgccgccagaatccaatgtgatgttcccagcatcaaactggaacaccttcatactgaatccatctggcaggctgcttggcacaacaaacgtaatgtctgctgtaccattccacaagaacgtcttaccgatatcagcaagagtcgcagtataagtattgttggtcagagagtcagcatagattggagtttgaacctttggtacaagacctttgatatcagtcccaatcgcctgagcgagaagggtgatgttagattcaatactcatgccttagccgtgttgtagtccgtaacccagttgtgagttgggtcgcctacaccaatgttctgacatgcttgaagttgttgtcctgctgtcaatgtctgtgccgcatcaaagcgtacacggttggacagggcagtggcaatcgttgtggcgaactgtggatcgttacccagagctgctgccagttcgttgagtgtgtccagagtcgttggagagcttgctacaagagcggcaacagaggcagtgattgcagcgttgatcttgtttgcagagtatgttgtggttgttgcgttggtggccgaggcatcgttgataaccgctccactgccagcactgatggaagctttcacttcgttgagtgctgataccaagttggtcttcgctgtggttgtcagagaagtgaggtcaccttggtttgtacgaagggtcttaatgtctgcaccaatagcttgtaccaatgccgtgatttgtgtttctagactcatatttagttactcgctaggatgtagtagaagagagggttggttgtaaaaccttcaatgttgtcagcgtcaccagcagtgccgggatcacctttggcccctactaatacctgactaaacgccgctggagcctcagagggctgtacagggacgagaaccagagttggggaagcgcttgtaaacgtcagttcgataatgtcattcatgcagtcctccgagtcacgtccttgagaacaaggatggatacggtattggtactgatggttttgttatcagaatttcgaacgaattgaatatccatttcagcgttcccgatatcccataattgggtatccacagccgatacagagagtgttcgggttgtaacagggtcagcccatgaacaaacaagttcggctaacagttttccatattgagccgtcctcacctgtgcagttacagtccagcctacaaagtacccgtctgggaatgtagaaggaatggcggcaagatgatcgaagctatcacctcttttatgagtgatcatgttcattcctcatctagttatattgcagacacgataaaacccgacacaaggccgggttctatgtttggtagcgagtagaggaatcgaacctctaagcgtgggcttatgaagcccgtgacaacaccagtcagtcttagcctactcgctatatatggttgccagagcaggacttgaacctgcaacctaccgcttatcaagcagttgctctaccaattgagctatccggcaattgtttggtagtaactgtagggatcgaacctacctatagggcttcgtagacccttgcctaatccaatcggccaagctactatttggtgccccatcacagaatcaaactgcgttcacggcgttacaaaggccgggtaatatcaatatacgaaaagggcattgggagctataacgtgcccgagacgagaaacagttgccagatatcagggatgacctgcccaccagcaacattctataatttggcggctcatagggaattcgaatccctccttcctgatagacagtcaagcgtgctaaccgctaacactaatgagccaaattggtacttctaacgaatgtggtactcccacggggactcgaaccccgttcacgagggtgaaaacctcgtatcctaaaccacgtagacgatgggagcattaaaaacttacttacagtaatttctgtggtagtggctgctgtaggcataaccgcatttggaacaacctagcagattatcaacaggcttccaaaccatcataattacttaccagacactgggtgtttggtcttttgacccttgttcggatgacgacctttgctgtctttcaagcgggtcttgtcaactggagcgtgttcttttgttgcatcatatggacgttgtgccatttgtatctctcctttgtgtttgattcatttgagtatttaaacacgacaatttgatcttgtcaagcgtttatttgcactggtatgcctgacaggattcgaacctgcaaccaagagagtagaaatctcctgctcatccaattgagcttcaagcacattaattagtaccgggagatttacgactgactagtatcgtcttcgtctccctgttgagcttgccactatattccatctatactctgcattacgcggagtgcagggatcgaacctgctatagccacatctcacatttggcgaatgagctaggattcgaacccagatcgcatggctttggaggccagcagcttgccgttagcagactcagacataattcgaggacggcatttataacacgctgccgtctgagcgtcaaatccagcttaccatatgctactgggactctatgctgatgagtcggtttatgcacgcccgttcagcctgtttatactctctgaacttatgagtttatcaccagttggtttggtgatcataccaaggcgcggtatgtttgatttgaatggctggacttgaaccaacactcacggatttatatacgtccgtagctctaccgattgagcttacattcaaatttggtagacccatcaggactattaaagtcctgtggaccgatatctttctgctcttacttctggcctgtatcgagcactttgataggtgcggttagcaataagacattcctcacagccacagcccgttttatacttagccctagtcccacagggcttatctgacttccttggtctgccatcttcaacattacacctaagatggctgtaactgatattacccagatcaaagtataaacccacgggatcgtcgctatccaaccaaggagtcacatgttcaatagagaaagtttctcttgacattggaaatccacacttgcaacaggcatcttgcccagtagtcttaacaaaattccacaacaggtctttaacaagccttccacttgctgtgcttggattcataccaagctgtctttgtttcttgtcgctcatcaactctccttggaggttagatttcataagggcagacccatcaggacttgaacctgaaatactgatttcaaagaccagtgtgataaccatttcactatgagtcaactatttggtgggccttgtaggacttgaacctacaacattctccttttgagggagctacgtcttccaattgcgtcaaaggcccttttgtttggaggcgggtaaaggaatcgaaccctcaccggctactaaccagtggcgcagttttcaagactgtgtaccgccatcggtgctacccgccgaaatttagaggttgcctgtggggactcttaccccaatgagtggcctcaataccactccgtgaagagacagcagaaccctcactgtctagtgtttgtcatatcgtgagcgacacgatcattctggaggatggcactgtagtcgaaacagacccgattactcaggcagtacgcttagcaggcggctcctgcaaccttgcaggtttaccatccaaatactctatggctagctggagcctttcaacagaatctcccagcttacccaaccctgtgttgcacgctgtacagagaagtcctcgtactacgcctgtggtgtggcagtgatctacattcagagacttactctctccgcaaatctggcatctgcctctacactcttctagcataacttcatactgctcttgagttagtccatacctactcttcaactgtttcttgtaagaatagggagtgtgacttctctgtcgtccagctgcaacagcttcttttctcagaagctctttgcagagcttgcatttcgagttgcggccatctttgaaaccagcgtgagccgagaagtctgccagaggctttgtttgtttacagcctctacattctttcataacacctctcagccaatctactataatttggttggacgcccgcgactcgaacgcggaacctaccgggtaaaagccggttattctagccagttgaattagcgtccaattatcatttagcaaaattgaatacgggagccaatggcttatcactcgtatcttcaatctcaccttctgttccttttgcgagctgcatcttcaatgcttgatcagatttaacaaggttgatatacatcatcacaagctcttgcttcatcttgaatcgctctttgtctgacaggtcgctactatcgctgatttcaatcatcttgtcaatagctgaaccgtaaatctttttaagaattctaagaccagcctcaagctcagtctttgtcacacctcttgcagccatttcagctttcgtagggcgaccacctttatttctctgttccattgctttacctcaattagatgtgagtggtagacttactacccgaaaggaggaggaaacaggtatgctccactcacgtaacttatacgatagatcatttctatctaagtaccataagtataccatgattgcaccgtctgtcaacccctgattcaattaattttctcttaatggcactggtcctgttacaccatccacaggatatcgccctcctacgtactctcgctctgtatacgagttatacacaaggcttctgcacacactacagaggtcttcctctttattggcgagcttattccatgcggggctatcattattgatcattggtacgtcgcagcatttgcatcgactcatattggtttccttatggtttgtagattatgtcatacaatctccttatctatcatttggttaggtggttgtatgtattggttattgatcttgatgtatctcgtagatgagttttgtatcggaaggtagactgtcccaaggaaacgtcatactgagcgaatcagcctaagacgtaaccttggtctaccttccatgcttctcgtagattgagattgcattcggccagcatgtgctggagagccaatggctcaggttctgttcattccaccttacggcgtcgtcgctacgctttaaacagattagactcagcttgcccagtagcatcctcttcataggcgtgttccctgatggccggtgagtgaataacgacatatctctccatcagtttttccatactaccacacatttgctctacgtcaagaggcttgacaaacgcatattttgtggtactatcaggattaatcaaatcaacaggagtaccccaatgactgacttcatcgacgtagttgaacacaacccaatcgtgttcgtcaagactgtagccgaacaaattgccaaaggctacagcgtgcaaaacacaattcccggttacccacagtttggtgcgtacggcaaccagatcaggctgttcaaaggtgagccaaaaggcaccacagtgatcgataaggaccacagcggcaaggttgaacactatgacccaatgcacttcatgttgctgctacaatcgttcgtaggagctggttacaagttcaaagataacggccaacacttcttcgacgagaaaggtctgaagagcgttgaaatggaactggtcaaagaagagccagccaagcaggaggtgaaagaagaaaagaaagctccagcaaagaaaacaactgctaagaaagagttgaaggctgagccaaccaaagacgagctggaggctgaataatggcaaaactaactaaagcacaatacgagttcttctacgactttgcaaagaacgacctgagcaacaccctgttcccaatcctacactcgcaaggcttggagctgacgccagatttggctgcaaagcttctggagatggttgacctgaaagcttacactgagattgtcggtacagcattccttgagcgtgcagactttgcaactatcaagcgtgtagacaagatcatgaagagtgaagacttcaacaaggtgctggttgcctcacatgaagtgagtgacgccgtacaagaagaacgtattcgtattcttagcgtgttgatcccaaccgaggaaagcgaagaagtagctgagtaactttaaggggccttgtgcccctatttcatggaggtgcaaatggcaaagcgtaataaggcacaagtggttggaactcgttgggagaagaaggaagagaagggtcgtgagactaaaccaaaatttcaagaagcccgtgatgaaggtcgcacacaacacgatacaaagccgctcaagccacgcaacgagaaacaagcacgttacatccagtccatcaacgaaaaccctctgacgattgccacaggctacgcagggacgtccaagacctacattccaactgtcatggcatgtgatgcctatctcaaaggtgagattgacaagattgtattcgtgcgtcctaacatctccaacagtaaatcgcttggtatgttcaaaggcagcgccattgagaagatggaaatgtggttgatgcctgtaatcaacatcctgaaggaccgcctgacgccgggtggactcgaaacagccattgagaatggtaacatccagtatgtacctcttgaagtgctgaaaggcttctcagctgaacgctgcttcttcattgttgatgaaggtgaagacattaaccaagaagaggctaagaacatcgttacccgtcaaggtaaggattgcaagatggttatcagtggtgacgttagtcagagcgccctgaaatcacacagtggtttgaagatgctaactgatatggcctcacgccacagtcacttgcaaattggcttcatcgacttcaaccatgtaaacgacattgaacgatctgaggcttgtaagcagtggatcatcgcatttgagaaagatgaaagggagggcaaatgaacgaagaattccaagtaaagccaaatcgtattctggtgaatcaatacgtaaacaatgaatacactgtaagatttacacgggcaatcgagagtgctgacgactttgaagacgagttccagctgtttgcctgtgctggtgagcgtgacgttatcaggctcgatatctgttcgccgggtggctctatggacactgggcacttgctgtgtcgtgcgttgtccaacactgctgctcacacaatcgcctacattggtcctacctgtgccagtgctgctacagctgtagcgttggcgtgcgaagaatgggagattgacgacatgtcctctttcatgatccacacagcgagctacggctacgttggtatcgcaccacacgtcaaggctaacgttgaccactgtgacatgatgatcaatcgtttcgtgcgtaccacgtatgcaggcttcctgaacgacgatgagattgaacgtgtaatcgacggtaaagaggtgtactttgaaggtgaagagcttgctcaacgtctcagtgcttatgccgtctatcgccaagcacagcgtgatgcctacgcaaaagctgaagaaggtcttgacgaagacccgtttgatctgtaagattcaccccatgagccgattgtccttgcgacagtcggccattttttcgcccagatttaggaggtgttatgagtttgcacaatgagattatgaatatcccggccattgtagaaaagggtgagacagcggcaggtcaattgggagagcttgcctataaagcaggacaccgtgaagcgttgcttgcagcagcagagcttgctcagaagtatgacgctctggttgaaaggctgctcaacgctcttgaacgccacaatgctgatgattacgttgacagcatccgtgaagagtacagcctgtatgagtaagcaaaagatcacggttgtagactacaaagagttctcccgctgggacttcattccaccagccacattctttatcaagaatgccatgggtgactacatttttatacacacggcaaagcgagcaaccgcacaagaatgggttgacaacgagtatggtaagggtagatactctgtcaactcaagccgcttacagaagggcaaaccacttggtgaagacagcaagcctgccttcggaaccgcaacacgcaggggtcagaagcgatgaatgtagaaccatacttttgctttgagcatggcatcaattacggctcagatgggtttatgtgcccagcttgtgaagaagaaatctgccgtgaacacgataaatcactagaggatgaaaacgatgaaagctagtcaatttgtacaactgctgctgaaagctattgaagatgaaggtggcgaccttgatgtggtgtgtcccggcgaccaccagatgctttataaggttggtggtgtagatgtcgccttcgtcgaagacattcaagagtaccagatggaagagaagcacattgacgaccttgaaggctttatcgctgatggtggcaaccctacaaaagtgttggcggtgtggggctgatgtggatcgctcaacaaccgtgcggcacttggtgtgcctacaaagagaagccacgtgagaagatgggtggttgggatggcgaggtgtattgtgtcctcatgatttcgagctgcgtcatcagctggcgtagcacactccgagaactgtcttttaaagagtatcgtgatcggtactcaatcaaggaggtgagatgaaatatgacaaaatgcacatggcaaccgcagaagcctacgagaacgaaagtcattgtccccgcactcaagtgggctgtgctctcgtactggcgtcgggaatcgtatcgggtggcttcaacgggcatgcgagtggtggacctaatcaatgggaattctcacctgacgggaacccagaggttgtacacgccgagcttaacagtcttggcaagtgcttggagcaaggactatcaaccaaaggagcaacgatgtatgttactctttccccgtgtctcgaatgttccaaactactggtccgtgccggagtgaagcgtgttgtctatcgtgacgagtaccgcaagactgacggtatcgactatctaaagaagtacaacgtggaggtgcaacaatatggactaccaagctagagtgacaacactgcaagaccgtctggacgacatgacagaggttgagcttgctgctttgcaggctctgcatgaccttcttgccgaagtgaagaagaacccacgtgggaggaagtatgaccctgtggcgttcattcaagatgttgagttcaccatgcaagggttgtggggcttcagccgagacgaagactaccacactcactggctgaccctcaaaggctgtacttgcccagagcttgacaacattgagcggtttggcaccggcaaaattatcaataaatcgtgcccatggcatggaacaaaggaggaagtatgagcgtaacaatcgtatcgacgtatttgaaaactgagtctggtgatggctacctttacacgtatgaccgtgtagagagtgttgatgagttcgttgagctggtcgaaagagatttgggccaagagcttgcctacgtttccagtgttgaggttgacgtgctgtatagtagcactgaagcgtacgagtaccagatggcgctccaagctcgaattgatgaaatggcggattattaatgatcaagacactgtacggactcgacaagaaaggcggcttcaagatttggactatccaagtagagcaagtgcattgtgatatgcctgaagcgatgatcaccatatcccatggaaagcttggtggcaaacagaccgtcaaaactgagagcatccttgaaggcaagcaaggccgcacagtctttgagcaagccgtctccgaggctaacgcacgaatcaagaagcaggaagacaagggctaccgtgagtccaaggaagagcttgaagagcttcctgtgctcgccatgctggctgctgactaccgtaagcaaggtcatcgcatcgagtatccgtgctttggttctgtgaagtacgacggtgtacgtgctctggcaaagaagaagaatggcgttgtcacgcttgagtctcgcacgtctcagctgtatagcctgccacacattgaagccgctctcaatattcacatgcaagatggtgatatctgggatggtgaggtgtacaagcatggctacgagcttcaggacattgtgtctgctgtgaagcgtactgacactcaagcggaggttgacgctgcaaaccgcaagcttgacaaggcttccaagctgtctcagaaagagcaggctgaagctctcgttgaatatggtgaagcgctggagattcacaagctacgtccacagcttgagttccacatcttcgacgttgtgtctgacagaagcttctacgagcgtgttagcgaccttgaagagcttacaggtgttccagttgtatcgcctctgatccaaatcactcaatactcgtggattgcagacgaagcagatatgaaggtgaagcacaaggaggctgttgctcaagggtatgagggcatcatgcttcgtaacttcaagggcctgtacgagagcggtaaacgttccgcagaccttcagaagtacaaagaattccttgacagtgagttcactatcgtggatattgtaccggacaagcaaggtaatggcatttacgttgtgcgaaacgacttgaacgacctccaattccaagttgtgatgggagacatgtctgaacgagcagcggccttgaaagataaagagtcactagtcaataaactcttgacagtgaagtaccaaacaaggtataaaggcacactacttccccagttcccaactggtgttgtaatccgagactatgaataaggagagacaaatgactgagaatttcgaagcactggacacaaccgtagtacaagtaaggtctgtactgaacttcatgtacgctctgggctaccgtctggacgagactggcaagagtggacggttcgtcagtgaacacccagctttcaaagctaacaagtacctgagcttcagcacagctacaaagatgcacaatctgcgtgatgaccaatgggttgtctatgacaatggtgttgcggttccaaacttcatcaacctgagcagcggtttcagcacgattggtgtgcggctggcccaagcgtcgaagcttgttgatcaagtgaagctcagcatcaacaaatcgggtacactcattaccatgagtccgatggtgaagcctctgaacaagatcgttgagggactgttgagcctgtaagtgtaaatgcccgcccacaaggcgggcttctttgtccctcagtaaggagaatcaaatgattgaactcacaccagaagtaatccttgagtcgagagcagaagcttacgcacgcaaagctcacggaaaccagaagtatggtgacaagccctacgcttaccatctgagcatggttgttgagaacgtcaaactgcgtaagaagggtgaccctcttctgtcaacctacgttgcaattgcatggctgcacgatgtgattgaagactgtggcgtcacttacgaagagcttgaacgagagtttggtgtgtgcatcgctgatgctgttcgccgtctgaccaagacaaaggacaccacctatgaagcgtacatggaaggctgcatcttcagcaacatggcacgtgaggtgaaaatctgtgataccatggcaaacctactggagagttttgccagtagtgggagcaccaaccctgccttgaaagctaaaggtgagaagggtatgaaaaagtaccctcgacagctgtttatcctgacggaaggtgttgtgtgaaggtcactgcacgccagatgaagctgttccatctgctggcaacattcttttgggtgctgatgggaattcccactgtactttggtggggcgagagtgtattatgggttggaatcatgagcatctacgccattgtggttgggcatctcgccggataccaaggcgctagagcagaaagacaaggagagaagagtaatgagtgagatttggtttacgagtgacctgcacttcgggcacaagaacatcgtagaatactgcaaccgtccttggacctatgaggaacaagacgcggagctggtgaagcgttggaacagtcgtgttggtctgatggaccaagtgttccatctgggtgacttcaccttcgctggccgtaagaaagccaacaagatcatcgagctgatcaagagcctgaatggtcagatcacctttatcaagggtaaccattgtcaggatggcctctgggaagagattgagaaagccaatctggcccatgtgatcgaggtttgccattacaaggaaatcactatcgaccgtacaaaggttgtgatgtgtcactatccttttgagacgtggaacaaggcacaccacggtgcatggcacctgcatggtcactgtcacggttcgctggctccacgtggtaagcgtctggatgttggtattgacaatcaccctgatcgtcaggtattctctctggacgaagtgaaggctcatatggacaaacaagtctttgaggttgttgaccatcacgacggaggacgcgagtaatggctaagatgcagattgactctgagatgaaggtgcttccgggcgtaggtccgggtacgatcatgatccacaacgagcaaccgccattcattgtgatggcaaccggcattgtggttggtgacgagtttcccggcgtaagccttgaggacggttcctacggagagcagtggattgtcactgagttccgagtgttcgaaggtaagatcaccttagagaattgaaaataaagcttgactggatacggccagagttatagaattctggtcaacgaaaacaaacaaaggagagacaaatgtttaagaatctgattggtggtttgatgcttggtctggcagcactggtgctgactggttgtggcgaacgagttgaagtgccgccagcacacgttggtaagatcatgaccaaagatggttatcaggacaacctgatcccaacttccaagctgcgactgccgttctgctggacctactgtgatcgtatggtgctgctggacgtgtcggacaagagttacgttgagccaatgaccatcttcatcccagaagacaagctgaacgtgagtctggatgttcgggccactctgagtgtcaaccagaagaaggccaacgagctgttcaactcgctgccacagcaggtgaaggacgaccaactgtcgatcatctccagtgagagcatctacaacacctatgcgaagcagattctgcaagctgaagtgcgggcctatctgacccagtacagtatctctcagattgcttccagcaacgagaagatcaacgctgatattcagattctgctggctaaggtgatgactgaacgcacgccattcaatgttcgctatgtgggcctgaccaacatcaagttcccagatatcatcactgaagctcaagagaacactgcaaagcgtcgtgaggctatccaaggtgaagaagcacagcttcaaatctccaaggttcgtctggagcgtgaactgcaagaagctcgcctgactcgtgctgtagagaaagagaaggctgaaactgaggctatgtcgcaacgtactctggctgagagtgttgacccacgtgtgatgcagctgcgagcgctggaagttgaacgaatcaaggctgagaagtggaacggtgtactgccacacaccatcatgggtactaacgtcccaatgatcatgaacatgaacaagtgataatattggggaggccatcgcctcccctttcttttggaggtggattatggtattgctgtttaatgtgctcccgttcgttgtctttgttgctctgttgtacctcagttggaaagttcgtaagccgctgattgcagcgcttgcagttgtcctgctactgggttacaatctggcccagccaagctacggacctaagggttttgtaccacgcactgaacttccagtctttgaaggttcgaggtcagagattactgaccgactgctgaagcccaagtctggtgaagagtacgacaaagcccgagagcagtcctacaagaacggtctgccatttatcgaacagaaggggaagtgatatgtacgtttacgttgtgacaagtgttgaaatgggttgggactgtgtttgcggtgtctacactgattacaaatccgctgtgctttcatgcttctttgatgaagaccttgaacgtccctacgaagagctaatggacgaggttgaagatggcgagacttcctacattatccaccaaaagcaattggagaactgagacatgtttgaagcactgatagcccaagggcttgtaaaacaaaagcgttacgacaatggcctatcggtcttcaaatactctcgcaaggtgttctacgatgcactctggaacactgaccctctgctgctggaggcgcgtgggattgtccttgacgatgaaggtaacaaggtgatctggcctttcaccaaagtgttcaactacggcgagaacggggctggctctgagctgacacctgaaaccaaggttgttgcaccacgtaaggtgaacggtttcatggctgcgtgccggtactggaatggtgagttgatcgtctctacgactggctctctggactctgacttcgctgtgttggctcgctctcacatcgagaagttgtcctacacggaaatggactcagagcttacctatctcttcgagatttgtgatccatccgacccacacatcgtagaagaagaggaaggagcatggctgatcggtgctcgctctatgaacactggaactatgatgacagaggcgtggttagactcagaggcacactttatcaaggccaaacgtcctgaagtgttccgtggaacctttggcgaactctgggagatggtgcgtacctgcaagcatgaaggttggatggtgatcgacgctgctacacgtgagacagtgtgcaagatcaagtcgccgcactacctgtccaagaagttcctgatgcggatgggtaacaagaaggttgaccagatgttcgacaacaaagaagagttcttgaaaacgcttgacgaagagttctattctattgcagaatacatcacatcaacgtttcacaaagacggctggaaagaaacatctgaagcactacgccgtgcagtgatcgaaaaattctttgaaatggaggatcaatgagccacctttatctaattcgaggcttgccgggttccggcaagtccacattcgcaaagacgctggctgactgcttgggttgcaagcagtatgaacacgaccagtatctgtacaccgaggaaggtgagtatttgtggactgaaagccggatggcttatgcctaccgccagtgtctgcgtgacacagaatctgccatggttgaaggcaacccagttgttgtctccaacgtatttccaacatccaaggcgttgaaaaactaccggaagttggctgaaaaatatggctatcgtgtgacgtacattgtcgtagagaaccgccgtggaggtgtgaacatccacgatgttcctcaagaagagcttgacaacatgcgtgcagcattccaagtagccatttaaggaggttttatgagtatttacaggatggaaaaagtgattgactgctctgactgggattctctggttaccaatacctatggtcgcacttacagcttccaacagcaagacgggtgcaaaggtcgaggtcgtgagcgcattcaagcaatgtctgaccctaaaaacgtgtatgacttcgaggacgaaaccgttcctgacgtgatcaatggtgatgagatgggcgtaagcttcgcagcatggcttgcccgtgaccctaaagagtgggacggtaaagctggtgatgagacttttctgggcatgttctgggaacgcaatttctacccaacagctgaagccgtcgcccatgatcttgtcaagcgtggcttgcttgaagagggtgagtacacaatcgatatcgattggtgattgacactggggctgtcttcttgtaagatggccccactttcacataaggagtgaacaaaatgcctgaatttaacgaaaacctgttttacacgctgaacgaaaaacaaggccgccgtgtatccatctccaccatgacctttccgggcggtgaagttggcgtgaacgtgaacaccggcagcaccaacgcctttgactactgggcacaggacgtagaggtgattgaccttgaagctcgtatccaaaacagcgaccaactgatggcgatgttcttggcaactgatgctctgcgtcgtgtctacccgaacgccaagatcgacctgaccattccatacttcccgtatgctcgtcaggaccgcgtatgcaacgctggagaggctttgagcgtgcaggtggtagctaagctcatcaacgcacagaactacgccacagtgacggttgtagaccctcacagccctgttctggtggctgctttggaccgttgctacgtcattgagcagtttgaagcgttttcccgtatcaagccaagctttggtgacgtgattctggtggctcccgacatgggtgcggtcaagaagaccgaagacttcgccaaacgggttggagccaaggacgtgctgtattgcaacaagaagcgtaaccttgcagacggcaagattctgggtatggaagtgttgaatccagaaatcctcacctacggttgccagctgcttgttctggacgatatctgtgatggtggtcgtaccttcactgaggtggctaatgcaattgaacagtgttcacctgcaaacgaaaacggtatcctcgaatacacaatcgagctggctgttacacacggaatcttctcgaaaggtgttgaggtgttgacaaacgtgtttgatcacgtatacactacaaacacattgccgcagaaggcacacagtaaactcacagtagtggagatgtgatggaatatttagtagagattttcgtaggactctgggtggtcctgctcatctgggaagcttacttcgttaattaaggggaaaacactatgcaactgcaagccgctctgaactctgatggttacaagctgggtcacgctgacatgtatgctgatggcaccactcaggtgtacagcaacctgactccgcgtactgacaagatttaccgccgtaccgccactcgtttctacgatggcaatctggtgttcttcggtgcccaaggagccatccatgaaatcgttgaaatgtggaacaagagcttcttcgacgtccgtaaggacaaagccatcgcacggtttaccaaacgtgttgatgcttatctgggtgctggtgtcgttagtgctgatcgtctggccgctctgcatgatctgggctacctgccactgcgcatcaagactctggacgaaggttcgaaagtaccaatgggtattccggttctgacggtcaccaacactgtcgatgaacacttctggctggtgaactatctggagactgtaatctccaacagcacttggaagacttcgacaaacgcaaccatcgctgctgagtacaaggctgcactgactcactttgccaaggaaactggctgctacgatgctttcggcatctctattcaggctcacgacttctcttgccgtggcatgtctggtcctgaggatgctgcacgttcgggtagtgctcacttgacctcgtttgttgggactgacaccttgagtgcgattgactacgttgaggactactacaatgctgaaggtctggttgcaatctctgtaccagccactgagcacgctgtaagttcgaacaacatcctgagcattgaacagaagttggtaagcaatccagcggccaatatcgtaggttctcggttgtacgctgagactctgttcatgaaggacttgatcactcggaagttcccaagtgggatcatcagctacgtggcagacacctatgacttctggagtgttctgactgtggttctgccaactctggcagaggatatcctgaaccgtaaagacgatgccaacggtctggctaagctggtaatccgccctgatagtggtgatcctgttgaggtgatttgtggtgttaaggttcatgaccttacacacattgaatgcaccgaatacttggaagatgcactgaatgacattggttatactctggcacaaggtcataacggtggagacgagattgaattctttgtccgcaaccgcgatcagaaaattcgacgtgttgttggtgaggcttaccgtgaacgctgtggcgatatcacatttgatatgcacgatgatgacgaagaggttgaactgacagcagaacaaaaaggtgcaatcgaagtgctgtgggaaatcttcggaggcgaaaccaacgaagctggttacaaagtgttggatcgtcacattggtctgatctacggcgacagcatcaccacaaaacgctgtgtagacattctggagcgtctgaaggccaaagggtttgcatcgtgcaacgttgtgtttggtgttggttcgtacacctaccagtgcaacacacgtgatacattcggattcgccgtcaaagcaacctactcggttgtagacggtcaacctgtcaacatcttcaaagacccgaagactgacagcaagaagaagagtgcgaagggtttgcttcgagtgattagcaacgcaggagagtacagccttcaagatcaggttactcaggaggaagaggatggtccgctgaatagcttagtcactcgtttcgaagatggtaagtttgtcaatcagacaacccttgacgaagtacgtcaacgtttggcataatgactgggcgctccgagaggggcgctttttcttaacctaaggaggtgaacatgttctggattttcgcactgatcgtcataacttacgcagcaatctacacttgcgggcgtatggcagcaaaacaacaacactggaaggataccctgtacgtatgactatcaaatataaagtgggtgaccttgtagaagctctcaagagtggcgaagtgtcctcaatcgggcaccaagccaactgcttcaacacgatgaactctggcgttgccaaggccattcgtctcgcctttccggatgcctacgcggcagactgtgagactgagaagggtgataagctgaagcttggctggtctagtgttggttcttacgtgcgttctgatggctctcatggtttgatctacaacctgtacggccagtacaattacgggtacgacaacaaaggctacacccagtacgcgaagcttcgtgaggcaatgctggatatgcgggatgatctggctatgatagctccacatgaagaagagttcttgcgaatcggcttccctaagatcggcgctggacttggaggtggtgactgggacacgattgtcgccatcatcgaagaggtgttcaaaggcgattgggatgttaccatctacgtgctgagggaggaagacaaatgctaacagtgattggttttgcgttcgtatgttatggagtttacctactctgtggcaagatcgataaaagcggtaagaggttttactgatgtaccgggacgcggttaaatacaaagagggttatctggctccgggcagtcatgccatggagctttaccaagcgaagaaattcgctgagttggataaacatctggcagagcttgacaaagcttggaggaaactagaagggaggtgacattgaagttttacacgggagttggatcaagagagacgccgagtgacattctggagctgatggagcgtgtaggatttgctctcgcttcccaaggttggacactacgctcaggcggggctgttggagccgaccaagcctttgaaaacggtatgttccgctgtgtgggttatgaccagccttacggttgggttcctgctgaaatctacctgccttggagtggctacgaaggccattataagaacactcacgggaatctgaacatcctgccaagcgatatcaggctggacattgaacggattgctgagggcatggctatgggtattcacccagcttgggaagcctgtaagcagggtgcaagaaagatgcacactcgaaatgtgttccaagtgttgggtaagacgcttgaccagccatctaaaatgctgatagcatggacacggttggataaagctggaaaccctaaaggtggtacggctacagcgatcaatctggcaattgagcaaattggtgaatcctctgtgttcaatctggcaaaaccagaacacttcgaacgaatcagtaaatggattggaggtatgtaatgtcacacgggacaatgacagctagtcaagctgaacagtacagcgagtatcttaccaaagtgcgagagcagtttgtgcaaggtgtcaaccttcttgatgaggaagacaagatgtacatgctcgacaagattgaagatgcccgttggcttatctctggaaactataataaaggtgtacatatcttgatggatatgatacaatatgctgtagaggcaagttatgtctctcctaacatgaggtttaaggaatggctacaaacaaaagagtaatggtttacatcatctgccgaatggttgaaatgggcaatcaagggcttggtcctatgatttccgattggtgggttgattgcacggtaaatggcagcaaggatattgcggcaatcaaagctgagcgtaacgctgctggcaacggcagtaaaacgtctgtggttcagtaccatgtgtactacgctgatggtggtcatgctcgcttcaaggagaattactacctcgcagaagagaaagctctgtggccttcagtaccgactgtagacccatttgggctgtacccaacgccagagctgttgcctgagcaattgcctgtatgatgacagcggaggaaatcgagactttgaatgctcgtatctctgccaatgctgacaagctgatcgctaagagggagaaaaccctttatgtgttcacaccaactgaggcgggccgcaagcccgcctcttttgttaactgcattttaccagagattcaacaaatacgctttatggacgaggatagttggcctttgtgggttgacgacgctgtgtctggtgtggcaagattagactggtatcgacgtggcaccaagagtgtgcctttgagtaagggcaagattctccaatgcttcgcatgccttgaagagataaacgcaagctcaatctcgcacctactgaacattgctgaacgtcaagctcaacgctatatgaaggcttgtcagctgttgcacgaaagattgattgacaacttctgtgatgatgcgataagatcaatgcgatacccggcagtgttcatctatccgagagaggacatgccccaaacagatttgaaggaggattgacatggaaattgctattgaaggtgctttgtggtacgaattcgaccagaacaactctggtggctacttcgtgcgtgatgattttgtcgctgatgtggtttacgtacaggctatgaacgctgagcaggctgaaggaattatgtcggggttgatcgacaaggctgaagcttgggagtattgcgagtgctgtggcgagcgttggagcttctggaatgttcagggcttcgaggttccaactcggtacggtagagatatctgtaaagaaggtattagcctgttctccaccagcagttatgtcctgttccacggtttgaatggtcgcaccctgaaatgggacggatgcagcaagcctacagaactggggaagttgggaaatgagttgtgaatgccaagtctgccgagatttacaacaccttgcggataagggtgttagcaaagaatttgtggctaagtatagccctgaaggtcatacataggagtgaaataaatgttcaataactaccactggtgccgcgaaggcggacaaatcgccgattaccgtcttgacttcgtgatgaagcagaagagcatcaacttctacgtcaaagacgtgccaatgatcctgtctgaggctctgaagttcaatgagctgactggaaagaccccacgaggcttgccttatggtgttcgggcacgtgtatggtcagacttcttcccagagttcccatttccgggtgaaactgtgagctattcggtgtacaatgagcttggtgaagcggtcgaaatcatgactgcttacgaagcctttgacatgaacactgttccgtgggacgatgtgatcgcatgaagccggttgaggataaacaccttgaccagctgaagaaacttcttgcggagacttacgatttggtgctagaatctgtccagattgagtttgacgcagccggaaggctgcacgtgaacgcgaggaaaaatggcgtagtacgccaaatagaaattaaaggagagattaaagatgaatgaaacattttatggtaaaatcatttcgagagtggatggacttcacgtaggctctgacgaagtggtgatcacctttactgatggttccgcactccacatgtggcatgagcaggactgttgtgaatctgtcagcatctgtgatatcgatacaagtgcagaccttgtaggagctgccttctacgatctggatgtttcctccaaggagggtgagacagactacggtgacgaagagtggaccttctacaccatccaaactgatcgtggctacacttggattcgctggtatggagagtcgaatggatactacagcacaagcgtcagctacaaattctgtgaagctggcgaagcacgaagctgctggtaaggtgtgccctatctgcggggcggaagaaccatctccatggtttgaagcaccaatgaatgacaccatccgggatcacgcacgctcttatgtgtctcccgttaaacaatatcacctcacgctttgggatgctcttgaagcgtggggcttgactgagggtttggagaatgagtgactactggaaggttgtgtctgttatcaagagttgccgcacctcaaggcagaacgacgtggcgtacagaatggtgcaactgtacgagcgaaagtaccctcagtccaacggactagcagagcagctgtatacactctgtgacgagaatcttatagacatttgcagtgtagggaggaaaccatgacagcagttgtagaagtgaaagcggtaacccgtgcagaacgtcaagcagctgaacgccgtgagtggattgctgatgctgtaggttacatgatttctatcggcttgtatgctcaggatgaaatctatgatgcactcgaccttgcagagaacttgcactatcactcggttgacgaaggtggtgaactcatgtatagtgcggtagacgctgtagatgaagaactcacttactggggagattgatatgagtgtttggcccggagtccttatgttcgccgtcctatttggtacactaacttttatagcttgggagatgagatgaaagcacgacagaagggtaagcaagactccaagcgtaagcttgaagcaaagtacatcaaggaagctgaacaggttatcaagaactggggcaacaggtcttacgcattctcaggggttttctatgcttgatccactagatttgagagtcacaaactaccctccacaaggtggtcatggtgcaagcggaatgtctgtaggacactccacaaacggggtcatcgtacaccacatcccgtctggggttggtgtatcatgtgatagtgaacgctctcagtgggccaacaaggagcgtgctctacgtctgttggagaatatgattccaacacctgctgagcagttccaagacactgttgaagctctttgggcttccgcaccccaatatgtccctacacctgtcgtagctaataaagtgcagatgatcaaggatgtgagacaacgtgcagggtgtggactcaaagaagccaaggaagcagtagacctgatgggcagcgttgaagcggctctcttgcacctgactggctccactggttattgcaaccgtgaaggtggttgtgtctgtggaggcgatttgccagctatccgtgaggggtgcttcaattgggtaaagtgactcctaagaagggcgactctgaaggtggttgggtgtggtatgtcgaacagattaaggcggcacaccctgaagcggtgcttgactatcaggctctgatgaagcattatattacaggaactaaatgggaggacgcactgtgagagagctgaaactgaggcaatcacaacaagactgctcttgccgtctctgtgaccgtatcatcaagcggaacgacgaagagcttgtattttggtctacaagcttaggcgggaaacgagttcaaatcattctgtgtaaggaatgcgtgaagcatttgaacaagtttataggtgttactaatgaccaagtggaacgacctaaaagtcaaaactacgatgatttcgaacccatgggtaaattttcaggagattggtaaaatgacagattggaacattacagcacacggcaccacttacgactacttctctgagagtccttcagagctgttctggattgaccctaagcttcattacaacttctggtgctctgtcctaggcggaacgtctggttcaagctccagccctcgcactgagttgcgtgaggtgtatgacttctcacgtaagggcctcaactggtcaccctttgaaggtgtccacaccctagcaggcactgtccgtgttgagctggctcctagcagccagaaggtgatcattggtcaagtgcatgcacacggagcctctaacccattcctgatgttggcatggtggaacggcgaactgcgtatccaagcaagacctacgccaaatggcgagctgatcaaccttgcacggattccttgccgcttgagtgatgcacgtaagtatcagatcaatgtgggtaatggcgaagtggtggccaacctcagtggtgtggtggcatcttgccctattgatcaagcttggagtgcatacccattctacttcaaggcgggtgcctatgtcatcgaccatgaaggcgagtggcatgaaggtggttgggttgtctatgaagaactgaaagtggagcacaccttatgagtgataaagaactacacatcaaaaccatcaaggcaatgttggtcatggttttggcactgatcctgataatcctgtttgtagcgatcttccctaaagtggcgggtgtcctttccgtgttgtttgttgtgggtcttatactctctgtcgtctacatgtcggtgtatgagattatcagacaaaggaactggaacaaatgagcaagtatcgaatcgtagagacaaggaaagaagggcattacaaatactacgaggtgcaggaaagaacgttcttcatctgggatcgcgtaagcagctttttcgataccattgaggaagctgaaaagtggatcaaattccagaaggttcagccagtagttcgcacggtggtgggctgatggaacgtgaagcgagactgtttggctgtataaaagagctggagaatgacgtcctccgctatgtcgcacggataggagttatcagagccactgaggcgatgaagcctcacaaggtgatgcagtgggatgatgggaaggtgtattggattctcatagaagattaccaagacattaatcagatcgctggattggagttttcccaagtgatgttcgatctgtcattccctcatgattatgattgtgtgagatactgtatgacaaggctcagaggacagcgtagcctgtagaacccaaccccgccgccaaaaataaggccctcttcattgagggcttttctttgcctataggaaatataactgacaaggcgagactaccgacaaggtgtgtcctccttgggagtgtcctttcccaaagccagatttgtgcgagaggtgcttaacacagagctaggccgcaaaggccagccgctagtaaaatgaaaataattctcattcgtatccatgaaaacgaccacactctcaaaggggtttctctctcaagcataccctgcccgagtgattgtttcacgtggaacactccccaaagtgattccgtcgcattatatatagagacactggcataggtcttgctagctcagaggacactactgacaaggggttatgcttgagaatggatatcatttaggtgctctcgcactgacctgttctaccactgacaagggctactctgacaaggtgtttacacactgagttgattccgtcgcattatatatagaggaacaatgttccatgtggaacactctctgagggtagtgttgtataggggtaggccctatgggtgagggtcttgcttgtggtgcgaattatcctaaatgtgattccgtcgcattatatatagagaaccactctcaggtggactaccactcagggcaaggccctaataggaacacttctcaaatgggaacctctctcaagtggaaaatcttggcatgcgatttgccttgctaggattgtgccaatctaggggatttgactggtcaggtgttagaatgttttgtccgtaggacatagggtcttattctaagaaagtatttgacaaaatggtaagattgtgaacgcttcgcttagtacagctcgcctagacggcgatcttccctgcccgagcgtcacggaaaggggtttagacaggaaaaagggtattattcatagctcaggctatgagtggttaaactctctctagggcttgtcccacgtggcctacaggccgatttgagcgacgttagtccgtaggacttagggttatgacgcctactgccgtaggcaggtttatacgaggttttagaggggtttttactatatttttattatccattatcaacaacaaagctaacgctttgctttgaaaggtttgctctcatagctgtcgctatggtgcgagaatgattctcaggtgcaaacgaaaaagcctccggctaaggaggcttgattctctaagctgtcgcttaggccaacaggaggttgatttcgtaaatcttctgtttcagtgcaatagcgcgatcttcagccattgcgaggcaagtttcgttaccgtagccacgcacgccagtgtggcgaacaatacgggcttcagcgtcagcaaggcgagacatgaggcgggctttgagtccttcgagcttttgcttatccattttgctatacctgtttaagtgggtgtgggagcattctatcaatgtagaacactccacgcaacacctatttaggctttaggtggatattattttgcagatcatgccacgaggcataatgaattggagcgcgtattgttgggcatcctcaagatgctggaagctttgaaactcccattcaacagcaacaccgcctgcgtgcgtagacacttcataggttggcacgtggattgcttccaagcccttttgtggctcggtttggaagattcgagcaatgcgattcagctcaaggttttcattgctgaaggtttgaatctttctcatttgcatcacctctgggagtggcccggctctcaccgggcgattggattagttgtagcaggcgtggtggtcaatgacgccagtctcaagccagtattgggcgagacgttctgcgtgggtatcatcgccgaagtcttccatgcgagcacggccaacgtagccaacccaagtgccataagcgttctggcggattgtgcgctttggagcttttggagtctttgtggttttcatttggttagccctttggcagttcgctttcgatgtagagattctacagcggcctttcgaccgctgcaagccttatttacaatttgaagaatttgttgggctggccttcaaaatcaactttgtagcactcttcaccactaccataagcacgggtaacgatggcagggcctacatcagtgtgcatcacgtcctgagagatagcaggagcacgcccagagattgtgttgtaggtggcttcgtcagtggttaccagacgctttcctgtgaaggctaccagaagggctttcacagtgttggtgttgttggtgttggtcatgttgcatcactccgttctggttgggtatgacgctattctataggaagcgttgaggccgtcaaccactattttcaattattttaggcatggctaagcccgctcaaggcgggctattttgttccacgtggaacattagaaggctgtcagggtgatcgactcaccacgcttaagcagaactgtcttgctggtgtcgatgccgtccgcatcaatgtggctaggctctggcatggcctcatatacggcactgttgcgtatggagacgataaagcctgtcaagcgctctacagcctcactgttgacgtttgattggctaagccttgccctttcatctaacaggagcttgagagtcttttgggcgtgtttggataggaacatgggaacatcctccttacgggatttcgctttctttcaagcgttcgcacctgtactcccacacgtcaaccgatttgacgtcttcagcgatattgaagcgctgtaggtaggcttgacgatgggctgtgctctggccgtcattggccgatgggcgggtggctcggtcagccatggcggcactccttgccaagtgggtttcttcttcaaggcgggtcaggcagtccgtccactggtctgacaggctaactttcttgagtggcatcatttggcctacagggatatcgcctgcaaaggcatcaaccatataggtgttgcaggccagatcgtcagcgcctacagcggtgcagagtgtcagagcaagggcgataaaggacattatgaaaggctccaaagaacgcagatgatgataacagcagaaacaaggatggcgagtttcacgagcattttctctttaggtgtcatggcttgctaccttgtattgtgtgggcttgagggcattctatacactaagaatgcccattgcaagtgttattagcgactaagaatctctttgatcgcgttgtcttgcatggctgtgtaatagccatcttcccacacggtagccataatgccaaaatggtaagggttggcgtccacctctaccgaatcaaggtaagccttcttgccttcttgataaatctgtgcagtggtctttggagcgctttgcatagccttgttgatcctatggcaatctttgagggcagcgataaacagtgaacggtagttcaagcctttgcaaccagcagcggccaaagcttcacgggtcagtttgtgggctttcttcataacgttcatgctgtcaccttcgattgagtgggtcgctgtctgcttccctatggctgtcattctacatcaaccaatcacccacgcaagcactattttcaagaaaattgaaaatttatggtgttgacaaccgccaaaggattcagtcacaatggcggtaacgtctcgccgaaacgcttttattccttcactatgtacggccagcctagtgcgtcccatgctttgaacttgcgttcaatggcccgaaagtgtgccatgttgtagacatgaccagatgtaaacaccttgttatgccgtgccacctcaacacgctttattgcccggtggagaatgatttgaatgttcatgtaagcaacccactcaacacttgcaccatggcagatactgcaccatgggactgacaacctgttaacagcaatgccagaccagataccgcaaccgtcctagggagtgtgccagagcgtacagggacgccgttatatgcgatggcatagtctcggaccttagcaatcttgagggctgctttaacagtgtccgtgacgtctcgtgattcttgaccatagacaatatagccttgacgtccaccaatccagttgagccgcatgatgttctggcctctggcgttctggatgtaaacccgattgccatgaccttgcatcatgtgaccttggcctttgtgggcgtagtacaggcccttacgaatcttggcaatcatggtgggatgggtcaagctggtaactgttacggccattgcaattactcctacgactaaaaggaacttctactattggcaaagccccaattaaggggcttgtcttagttcacgaaatcttcccaagtccggttagacggtgggttttcgatttgctctggtgttaggcgttggttccgatgggaccaaaaccatttagttgcatacctttgttgttcctcataatacagctcttcagccgtataacgggagccgcaaccgtcactggcggaaccgcactcagaattgaaagctttctcgaaaagctcgctaacttctttatcggtcaagtgcaacattctgtgctactccaatcggttaaggcgttttgccttgtgtgtcgctcattctacagccttgaaaacccatgtcaacaccttttcaacaccttttaatagcaaccttcaagaaaatacaacaggaacaggataacgccgaactctagcaccagcaggctcagcacgcaaatgagaaagattgtcattagcttttctaacaggcccattgctctaacctcctaggatgaaagaaagcccctcactaggaggggctgtagtgttacgccgcttgctcatccttgacgatgttattacggcttggcagttgaagcaaccaacgaatcatgtcgccgatgacagggtagatatcgttatggcgtgtgccaaacttcatccacttgttctgtgcgtcgaatgaaccgatatcacggttaccagagccattctctggcaagtaggcacgcaggccgttgagcttggctttgatgcgttcttgctcggtcatctcatagaaccgccatacagggttagtgtggctgaagttcacttgagacaagttaagcaaaagcttttcaaggtcttcggcagcagactcatcacgacgacggccaaaccctaggtcgtacacaagctttgcaatggccttcacgacgacaggctgagccataacagtggtagcctttgcccccggcttgccgaagccaggaacgttcgctatagcgtgccacatgcgataggctgtagcttgtttgtcttccacatccttgggcgttgcactggcaatgctggtcttgttaaggaacaggattgcattgacagcggccagatcgcggaaagtccaacgtcctgtatccttgttccaattggactggtcaccatcgatcacatcgtcccaatccagaatgttaggcaacaggtcattctggataaactggttaaccgggttggcactgtcaaacttgagggccaaactcctttcaaccttcttggcaaggttgttaagatcatggaacagttgttgttcctctttaacgcccaacccaagatggatttcgacagcaatcttgcaaaagccccttgccacttcgtcgcactcatcccaagcggccaacacatcattaggaatcacatctttgaagttgccttcaaacagtttgggcttgcgtgggtatttgcgattgagacgaatttcattaaggaactcgaaaaccaaatccatggcataccggcgatgctggccgtcgatcacgtagagcagatcgcgttgtccaaggtacactttaaagcaggccgtctcgccttcgctttccatgcgcttaccttcaatgccacgtccgcccggatcacatgtgcgaatgttggcgacgatgggttgcaacgacatgtaagcttgcggacccataacacgctgtagctcgttcaaggcgtcagactcaggcttgccgaagttctggcggtattcaattgcagcggccagcaggccacgcaggatgtactttgcaagggctgtagcgtgtgcctcgttgagtgggcgttgagtggctggcgtgccgtctggctggcgctcgttcgccacctttgacatggcgtagaagtctttcattggaatcagggccatgaaagtgcgatggcccaagttgtgaccgatgaacaccttttcagggcgggcgctgctgtcagcttctttcaacagggtatcaatcgaagcgattggggttggcagaccttcattgtcacggaacatggcgtttctcctagagtggtgattgttccacgtggaacgttcaacaggcggtttgttttcctgttattcaaaggatagtccaacctaagcaggcgtcaaggagggaatgcaaatattttcagaaaaagaaaaggccgctctaggcggccttatcaatcaatgggttagcttattcgtgccagtcaatatcgacgtcgttgtcgtccctcaactgagaatgcaactcatcctgcaaatactttgtgtactccaccttcaggttggagaataccagaggcgcactactgtacagggctttaccggctttgatagctatgttgcaaatgataacctcatcatattggctatcaaggtgtttcatcatatcgtcatcactgacgtgaacaactccgctgaaaactgcacagccatggaaagccttaactttgcacaactcagaaacagcttgattctgtacgcccatcttctacttacgctcctaatgtggctaggcgattgcctaaccagtggtgaccattctatagactgtaacgtttatggtcaatagctgaatcgattatttacattgcctttacacaaagcaaaaggccagctcattggctggcctagagtgtttcacgtggaacaattaggcaaggtcgatcacgaaaccataacccttaccatctggcatactgccaccgccagtgatcgcccattgaaaatcaccttgacgctctttgttcaattcgtacacgtagtgcccaacagcaacagcgtggttttcttctacggacaaattatggtcccaaggataggttgcagaattgatccagcctgtaaccttgatgcgagcgccacgagtgttagtcggtgcaacgaatttagtggtgattacttgtgccatggtgcgacttccttttagtggtgagaggctgtcttgcctctctatggtgatcattctacaggaatgaactaccttgtaaagcactatttgaaattcttttactctgataacaggcagcgcctgcttcagttaacaactcagaacgataccagtgtatgccccagattgtcaacagggcttgcaaacttcttgtgtgcccattgccttgggcgtggggcgcagtttgcttgtagtatatctcgccatcggcttggacgataacaccactgattccgctgtctggcgcgtcactctcaaacaaggcgatgcggtgccatcctttgtggtccctgtaaagctcgacccgcttgccgtccgggaaactcatatcaccaatgaggcgttctagtcctgtcgtgctgcactgattgagcgcgctatagatagtggagttcataactacaaccttcaagaatacagcgccagcggttaggttggcgctctttgttggttagcctctggcgataatctcgacagtttttgcggctgtgccatgggcacggaaaccgataatataatctcggtcaactttctggcacaaagcgcaagtttggcagtttacgcggtcactgttttcagcagggcagattacaactttgttacctgctggcgtataacttactttgtctgcgtcacgtggcatcatgactacaacaggaccaatgttcaaagctttaagctggtctgcgtgtgcagtggtgttgcccgacaggttgattgtaaagcctgcatcattagccaaagctacagccaaagcgttagaaggtttatcaagtgtgtcgtaatgcgtgtatgtaaagccacgtttgcccttattcgctaccacaagttgatctaacatattggtatcaataaaatcaccatagccgttcaaatcaccggcttgattgtgacgccacaaggtgttagacggcagacgctttacgttcttgataaactccggccactctacagcgtcctttgcttgaccgctgtcaaccttacgccatgccatgccagttgggccatacttagcgtaacagcctttgagcttgatagggcatgcatcggggcaagtagagctattgctagtgctgacaggcataggaccagttttgcggttgccggatactgctttaagaacgtagaacattgctaacctcggttcgactgcaaaggcgttattgcctttcgatgtgggtgattctacagcattgaaacagcccgtcaagccttcaatgaagaaattttgaagaaaagcagaacgacaatcaccatgatgcacttaatctgccacggctttaggggcttgcgttgtacgaccttgaccggaacgtcaatcgacttcgaaggcttgatataacgccccgtggccttgtctagtgctacctttgccttagcctcacgcaggtctaaagcttcatggcagtctagataagtgtcgtactccatctggtctagttcataagccttttcaagctcaatcctcagatcatcgatagtgtcaatctcgaccgcaccacggcctaagatgcgacgatgcaacggaacaacaggttttacttttggtttcgcttctggttttggtgcccttctgataccagccatattagaaccccacataccaatgaccgttaagcttgccaagcttgcggggttgggtattggtggcgattgcccacataacagcgttttgaactgaatcaaaccaaacatagaacaacatagtgcaatctcctagacaacaaccttaggtacttctaccttctagcgtacagtgtagacaacgaaaaagcccctgtcaaggggcttagtgttttcttttactcgtcttgttcggcctgtaggaaaccccgctcccactcgtcatgctctggcgtcccatcactgtacgggttttcactacgccacacgccatgcttgtacgcttcataaccttgctcatatggctttttcatttattcggcctcattccaaatgccccatgcaccagtgccgcgacggccagaacgacggccaatctcgctacggcgttgttgtttcttagcctgttgatactgataatcctttgcgaactctacggctctcactactcgcataactactactcacttcagttgtaggcttgattgcctgcaatgcacactggtaggggttgcacctacactgacggccagcattacctgttttaaccgctgctctttatttaagctacagtgtgcattacaaactcactagcggccagcctttaggctagtcctcgaacagatattcggtgccgtccaccttagcccttgtcatcttcgacagggtgatattaacccaaggatacgggttgcccttcgccatcttctcagggtcagcggctgtgtagttgtctgggttgtgtgccgctgggttggcctgcacgatttcactggtgccgcttgacagggctttgttcatccactgcttaacgacgcggctcgtagtggtgccgtctttcttctgccatgtcacgccaaagacttgacctttgttggcatccagaatttcccgcttacgttggatggaagcgcctttgattgtgatagtagccatggtgcatacctctggtttgtgtggttgtattgtagacaacggttagcaggttgtcaactaggaattttcaactcgtgggcttgggtataatacagcccttcgaacggccacgtgtgacctacaagcaactttatcaccacacgtcggccagtgtcaaccttagaaactggcaaagaaaagcctttgccgtcgaaggcttcccaacctacaacaaagcctgcaccgtgctcggtcaccacgtcatcgccgatctttagttccattagaaaccccgtgaattttgccagtggcttgaggcgttggcggctgcctcatcgtcaagcccatcgtcataatcaggatcgaagtcatcgtcctgctcgtcctcacaatcatcatagtaatcgtcaggcgggtctagcatgtaatccataaactactactcacttcagtttatctgtgtggcctattctacaggaacaagccacacatgcaagggttaaatgcgttttactttgtgctgctgtgcaaggccagcgtccaacaaagcgatatcacccgtcaagcttgccaactgcttttgcaggtcttcaatctgcttttccaaggcgctcttagcttccaccttttcagcgatggtagacaggaactcacctacagtgtgctcgcctgtcaggctgctgtcaaccttgacaacatggctcaaatcaaggtcattgtagttgtcaggctcgcccaagcgatggaagctaggcgacgacgactgatcatcgtaacgcagaacccagatactgctattgtgacgaccactgccagtatagcgcaccatatcgccgacctgcaagccattgcgtttagctggcgtcagacggtttaccagatcatcggaccaattggtcttaatgagttcgatcacctcgcccaactgctgcaaacgattggcaccatactcgccgccccacttgtcactataacggcagaacgcatccgaaggattcaaaccctcaacacctttaacagggtacgagtagtcgccgctgtaactggcagtggtgcgaatcaagttttccttgacttcagacatttgacgtacgttagcacttaccgcatttgcgaagcgttcgatgttatcgcatatcccgtattgatggttgaggcgagtagagtcaccattgcggtaagccactgccgcatcatacatcatttgaaaggtgtttactgccatgttctgcaatgctgtgtagccatgcggcacaggcggtgccagaggcgttacggctggcacttcaggcacaacctcgacttcatcaaggttaaggaaacgtgtgtcgagcgtagcagtgtgctcgaacagtgggcaggtggactcgtcgtcagaaaacagacgtgcagtagtccctattgcccaacgtccgccacggttaacagtcaagcgaaccagcgtaccgacagtgatacccatttgctgggctggcgtgcggtcatcctcaacagcttcaaaggctggttcccagatactgatatccgacagagttccgttttcaaacacaacctgatataccggatacgtcgagccgttgatagcttgcttcactgtagcagtcatgccaacataatcaggaccacaaccccaaccacaagctactaccttgacaacttgacctactgcgaactttggcgtcttcatactgctacttcctttagccttagcggctgtttcgtttggtgtgccgccatcttatcaaaacctgagagcacgtcaaccactattttcaaattattttcactgctttctatccatccagcgcccgagcgcacgcgaatatcacagaaaaatatttactgcaagtggttgcattgcctgtctgggtctgtataatcgtacacagcaggaacgacagccgggaggccagacactggagtacaaggtggggagggtgcccgtcattctggtaatgcgaatgattatcaacagcagatgtaaatgagaattcatctcaactctagatgagaatgattatcactctcaatcgctggggagttggcgtgctacaagaatctggtgtggcacgtcactctcccgaattctctatccacgtgaggctgaatcgctctgtaaaaatcgacccgtttctaaatttctgtaaatttccagccgtttctaattccctgaaaatctatccgtttctaaatttatcagtcgaagatgctgccgatcatgctacccacaccactgatcacatcaccagcgatatcacccacggcatagcccacagcaacactaacagccacatcagcaaggtcttctaagactgatgtactggaagactcacaccagtatgctgaacacttcgcatgtttggagtttgctgtgaattctctgccacaagagcggcatttaagcttgtaggacatggtgttctccttgttggttgatgtgtgtatcatacagtgtatgactggctttgtacagctctctgtgaaaatctatccggggaaattcgctatgcaaaaccttttggcgaataccctgccgccataaaagtaagctggtaaagtaagccgccctaaaagtaatgggcataaataaacccgccgaagcgggttattcttttgatatcaggtacatggtaaagcctgccagagcaaacatacccaacaccatgactgttacataaaacccatcgtcatagccactcatgagccgtctccttccaagtgttgcttcagctgggatagcttaggaaaggcttcacttacaatctttccctcgcatcctctgggcttatacacccagccgctttcctcgtggtagatgcggcctatctgagtcttcttccatttcacgacgatgtaatcgtctttctgttggtagttgatcatttccgtttacctactggtgcgtaaagcccagtgacttgtccgggccaatgcttggcaactccccacatcagagtcacatccactacctcaccctgagagttaacaagcgcccaagcagttggaaaagtaggctcatcctcaagcacagcattcagcttcacagcgagtgcgtgacactggttgctagtcaggatagggcaaccgggaatatccatgtgtgcccttacaacatcagccatctcaagcttactcattcttcgttgtcctcaactgtccaagtgatacccagatcagcgtaagtcatctgctcaggcaccatgatgcagtcaggaccagagtccatcccaccaaaggagttagggttctcgtcgatcacacgctgtgcaagctcaccatcaaaggtgtagtggatcgaaacgtaaccatcagtgccgccagcgatcatgtacagaggcttcatcttaacttgcattgtgtatctcctagtggttggttgtgtcacacactttacagcagattctctgggaaagcaaacgattattcgtctgctggtttagcttcccacacgccacggccagagcgacgacgctcacgggatttacgagtgttcttgcgttcctcacgcttagcccggtcgtactcccagctcttgccaaactcttcagcgttcattctcttcaaaaccctactccttcattcttgcttggtagtttccgcttcacttccaagatgacttcaaggtcaccatgggttgtgcggtattgctcactgctgatgctcatatcggcgtgccacgctgccaacataccacgcatgaaggtggcgtgtgacagtgcttcctcgtaggttgtggccttcaccacaagcttcctgatatcgtccagataccgcattttctggtcagttgtcattacttgcttcctttgcccttaatcaggacaggccactgaagctccagctcttttacacagtgggctactccgaagccaagcacgatcaacccagcgaatgacaggacagtgcatcctaacagatcacccaagtcgaagtcttcacctttcttcaggtcagcataagaggcaatcacacagcccaccacacccaacagataccagattacaaagactgtgtaaatgctcatttcttaactccttcaatacgtttcagggccttgtcaaagatgttccgcccagcacgcagaccaacaacgcccagcgattcaaactggttcttcatctgattggcagcatggcagcaggccacaacgttgcccttcacataacccttggagccgtcaatacggtcgatggttgcatctgacaaacgcatctcaccattccctgtggatttggtcaaggcgatgccagtgtaatagcagcgcttggcacccatcaggttcttcatcgactgaaaggacagatcgaactcgattccacgcttcttggcgttctctgctttccaagtcagatgcttggcacagtacaggtcgaattcagctttggtcatgttgctcatttgaaactccgttgtgtttgtgttgggctattctgagggcttccgccctcagtgtcaagcgatctttagaactgttgcttaaccttttcgagggtcatcagcacttgttccttggtcaggtcacccatacgcagctcattgaggatgcgttctgccttggtgtcaatcttctgttcaaccttgaccatttcaaatgcgttggaaacatatttgaacgcttcttgtgggttggtgatacccaccttgatcagctgacgtgcagcacggttgaaagctggctgaatatcagcgtgcgatttgatacgaccatcaaagaactcatggttgaccttcacagtgctgcgtggagtacctacgtgttcaccagttgcagaaggtgcggtacgaatcagaccacttctgatctgagcgtcccactgttgaaagcggttgtaatgcttgccttgaccggcaacaccatcaaacaaagcacttgcctgagcgtagtcgagattcaactgcttgcgttgagcattcagtgtgagacgatcttcgacggtaaacgccttgcctttggcgcaagtagctgctcgcttctcagcttcgtggtagttggctacgaattgggctttggtgatgattttggtggtggtcatagtatatttctccgtgttggtttgttcggctattctagccagttaggtgttcagtgtcaagcgtgtttttaatcttttactgcgaaggtgataaccacaccgccgatgatactgacaatacacgattgaacgattgacaagtcaaacgctggtgcaattgccacagcggagaacataccccagatgatggcacagatcattgcattactcatacacactccttcagaaagtgaaacatttgatcacagcttcagcggcttctctggttgggaagacgcagtatttgctccagtaggagcggtcataccaccagaagccatcattcgtgccaaggcagtagcgcatgcccagcagattcctgcgggtcacaacatacccacccacacacttcatgacaaccctcatgccgaggtgatacttaaccctgtttaccacactcacattgtctctcccacgtatggtttcagtagatggccgttcctttggaagcggttgatgtagtcatcttctcccagctggttgtacaagtcaagcactttatcgtaattttcccatgcatattcccgaaaccagccagaggtgatgcttgtacacaccttcatcagagccatctcaaagctccagcgaggcgttggcccgccttccttacccaagccatggggaatctgggaacgctccagagcgagcacacaggactcttcatagacgccgtacaggcggacatgttccggtacagacatgaacttctctttggaggtcatcacctcagagccgtccttcatgtagtatttgtaggctgggaacggagactcatcaaatccaagacccggagtaaaccccttagcactcaacgccacagcctcatgaatactgtcatgctcatacacatactgcacaccatctccagtgaagaagtccttggaggtgacattcagctttgggtgtgcgtagtcgtaggactcagcctcacgggctttcagcaatgctctattgccgatattcacattgatccagtagtttgcgtctttctccccaagcttctcacgcaagaatttgatatcactcatagtcttgaggaagtgtggggagttacgcttatagcgatggctcagcttaatcagcaacaggtcatcattgattgcaacggctgggccgatttcaggaaccactttgaaatctttcaacccatactgaatcagtagagtttcagcagacgtacccggccaagccagctcaaactcatagttcataccgtctttgtcacgtgcatggtaatacttcccaccttgggttgggacagcgaactgaaggttgcccttgttcgccttgtgccacgccttgaactgatccaaggtgcagataaaatcccaatcgacacactttcgaatgccttccagttcagggttgtttgcgaccagagcacgactaccaatcagaagcatgatatatcctcagatgaatttaagaccagcgttagtgataactgcttcgtaagacttcagcttgttttgcagtttggtgatttcctgacggatagtgttgcactctttcaccgcctcgtcaaaggtaatcgccgcagggattgtcacctgtggagttttgatggactccacaagctcaaggtccacttccattgcagaccatgaatcctgatctgggaagtttactttgtactcaggaacgctgtctgggtcgaatacccgttttacaacacccacatcacccacactagcgtacccaaggccgaattcaggatttgggttgatcaagcgtacacggtcaccagctttgaatttcgacatttgtaaatctcctttgtttgtgtccgctcatgatacgaaaacgctccgaggctgtcaaccccagagcgtaatttatttagcagctttgcgaagaggcgttccagaggccaacatcttccgcatcgtcgttatcagaccgttgccagtcctcaacagcggcagcacctgtgtaggaaccacccatgccatacgtgccaaagttgacagtgaacgacagacccaactcatcagcgatagcctcagcttcatagacaaggctctgggcctcatccagcagctcattgatgcgcttaacaccttcaaactgtgtttctgtgcccttgtaggggttacgagcgcccattaaatgttccatccgtagtccgaaccttcttgagccgactcttcccactcagagcacgaaccagaagcttcccacaggcttgccggggtatacgtttggctgcgtccgtcacggtcagtgaaggtgaacggcagttcagcatcctcagcagtttcagcagcccagtctttgatgaaatcttccagttcgtcttcatctaagatcagagcgccgccctcaggcaggttctggagaaccagagccagcttcgaaaggttgtccagtgcattgtcggacagaccttcaagggtgtggccttcgtagctgtacggtgtaccgttatgatacgtacccacatagcggttcttaaccagagagataccagcagccagttcaacctgttcaacgatagtagtagtgtgagtcatattgtttctcctttgttatggattagttgttagcaatacatcgaactggaattccagtcaacggcatcaatcagacggaagtcattggtgtatgcacccaccttgatgttcgctggaatgttgtagtggtttgccagacccagcagttcattcataagcggggtcacttgttcgaccaactcagctatacgggctgtagcctcacgacgctcttcctcgtactctgccagctcagcagcgaaaggcccgtcgatgtagtcttggatttcctcgacagtgtaggtgagttcttctagctcaacctcatacctgtgtggaccgagacgttcgctgtcgatgtagtattcatcgatatattcacggccattcttggagtaaacagccgtccgttcggtttcgactgtggttgcaccttcaagttcaaggttgccatcttgaatcaactttgcaacgtaaagaatagtattcatgccttcttacctccttctttgagacgattctctttcttgtggtcagcacgggaagcgttgtactcaagcttctcgatgattgcacctgccaagtccagaccctcatgaccgcacaggtcaaggatacggataacagcatctgccagttcaacttccagcatcttacgctctggcagtttgtcgtccatcaggtctttacgagcaccttcaagagcttcagacacttcagagtggaccagtgccagcttggacaagatcagcgtaacgtcacctttagggtgagcttggccggtcttgaggtcttcccaccagccagcttctacgttgcctttgtagacgattgcttgcaggctatcaatcgcctgatgaatgcttgccacgtgacggatatttacggtgtcgatcatttgtcctccttatttgacgtctttgattgttgcgaatgtgtagcccttgccgtcctgtacaatcaacgggaaggtgcggaaacccaacatgccaagctcatcaagcttgtccatcaagtcttccatgatgtagtccttgtccagctgtttgtactcaaagtcaatgccgcgagactttagcacagctttggattgctcgcaagcgctgcaagctgatttaccgtaaatagttaccatattacctcctagtttaaggacaatgcacaagtggcaaaccctgccacgaacgcacctattgtacaggacacggcagtgtccttcatattgaggtgtgcagctaagaagcccaagagcactagcaacacagtgaggctgaagaaggcccaagccattagtagtcctcttcgccgtaggacagaccatcatcgtggtctacatcaaacagatcagagtctagcagagaatcacactctccgcaatactcttcaaattcttcgttccaacagtcacagattggacagtacatcaatcatcctccatcaattgttttgtcttgaactcgcaatcacgcaagtgactataccacatctcacccatttgtctacgcatatcttccagctcctgaatcatcaagctgaccttagccatacgcttctcaaagcccttttgatcatgggcgtcgaaatccagattaacaggctctccgtggcaagcacggaatgacacactggcagagaggttcgggcgaatggtgccgtcaccccagttgtacatgtccttgacgagcggggtttcgatcagacaaaccatgctacccgtttcatgagggcacggcgagagaaactgcttggaaacgtaacgcatcaaacctccttgagcagacactcatcggtgtctaatttgtcgtagacctccatgacagcctgagcatactcagcgtcagctgaagggtgcagcactgttgcccctcgccaaatcaggtagtgctgattgagggctgtcatgcccaagctcttggcatacttcatgtcagagatagcttcttcacgtggcgtcattctccaacctcctgtgctgtgtcgttgacacattggcctagtgtccttgcgtggacaacctcagagccgtcaagataactcacccagcgtagattgtcaaccttctgaaaggagattcccgcgtcttcgagctttgctttcacttggctggtgtatgtgtgttgcatgaaaaatccctcgccaccgtttctgatgggagggattctacacaggcttcaggtgcctgtcaacctcttattgacacatttcgcagtattcaacacgggtgatgttcccgcctcgcatggagtagacgtagtacagagacagaatcccttcgtcctccatcgccagtctgtgaatcttgctgatgtacttctcactgtcgttgctggtgaagtagaggttgatcgattgtgcttggtcgatgtagcgctgtctctgagagcacagacgcaggtaatcttccattggaatctcaaaggctgtgcggaatacagctttctcatcatccgtcaaccagagtacgtgttgaacgctacccttagtggcgttgatttccttagcacattcctcccagtccaagcccttctctttgatcagctccaacaacaccttgttgatacggaagaactcaccaccagcggattgcttggtgaaagccatcgccgtatcaaggccgataccctctgaagctcctgccatcagttctgcggtgctctttgtaggaggcatcatcagacgtgtagcattgcggataccgagtcccacacagccttcaggctcgcccaagaccttagccagccactcagttgcagccttgctgtccttgtccagtcctcggaagatggttgtgttcaacatcatacattccatggaactaacactgaagcgttcccgctgcatcaatgtgtgccatccaagaacaccagacccaagggcacggaactctttggtgaagcgataaatcttcgccatagcacgacgatcttgtgcagacagctcgtccatcgtctccaagtattcggagatattgcaatcgctcataacctgaccaatgaagaccaagtgtggcggccaactacggtacacctccaagttgtaattgaggattacacaactgaatgtgtaaaggtcattacttggcaagcaagtttcttggcaaaggttggaagcctcaactttcattcctttacgtttgaacgctttggctaggtgacggttcatcttgtcaatgaacgtaaagtagcccttacctctgaccatcttgatccacatcatacgacgccagcgtttcaacactgtaggctctttggccttcatcgctgcacaccatttgtcacacagcaaccaacccaagttgttagactcagtacgttcgtacaggtgcgaggctacagcataaaagtcaccatggaacgggctgatactgtatgcacagctaccagagcgtggcccttgggcaacttcttccatgacattgatcgtgtcccggatgatcggcataacacccttggagcgtccgcctcgaatcttgtcaccttcagcaggccagttgttcaagctaaacgacgtaccatgagagtgtttggtgagaatagcaatctcagtcatcatgtggtagcggtcgtacaggttgttgtccagcaggccaccagcacagctcacagtcgtaccctgttgacgtagaccagcgttagccagcattggcgttgacggacttacaaagccgtcccacagcacttggaagaaagcctcttcccaagtcttgccagcccagtagggaacgttgttccaccactcagggtaaacctctggtgcgtgatctgccattgtcttagccacagtctggaaacggcttctaaccgtttctccttggtgactgtaacgcttcatgaacagttggtatccgccagttgtgtaccactcagggcatgtcccgtctagttgagcctgtttacgttgtgcggaataatctgtcactcttcatctccttcttcgtcttcccatgccgctgagaagtcttcttccttccagcccatctcatattccatacccatgccgctagagaagaagtcaatcatcttgtaggcataagtgttagtttcaaaccaatctttgattggggtttcttcgttgtcgaatgctggatcaagaccaatacgagcaaggaagatgttcaggcgataacgaacgaaggctttgaagtcttcctttgtcataccattgagtttgtcttcaatgaacgccatgtcaatgattcggcattcatgctcgtaagcatagttgacagcctcataaatctttacgacacgcttagtgtcttctcttagtggacgtcccagctctctgtaacgcttgttgataatgtctgcactgataacgccgtgcaagtcttcgtcaactgccgactggttagcaccacgagcaactacaggaatctcgttgtgtccgttacactggaaactcttgaggatggcgaacgaactaaacagcagtgcggtttcagtcatcgagaagatgatagttgccaacactttgtcttcaccagacaaaatactttccagccattcaacccgtgctgccaagattgggtcatcagcgaaagccacataatcgtggtctttgtcaaggcccagtacaatgttgatctggttatagaactcagcgtgaaccgccaactccaccataccaagcacacttgcagcaagcttcacttccgggcgtgggaactctcgaatgacaaggccattccagaactcttcaccaacgatcaactcgtaacgcaggaaaagctgtagaacagtcttaaccgcatggagttgggcaggcgtcagctcataaagcatctgcatcttgtcacgctcaacaaccatctcagagctaaaccagaggttcttttccagctgttcattggctagagccacaatctctgggtagtggcgggtgtagctcattgtcggggtttgaatctgtgtcttacggtcccagtcaaaggaggcattttcagcctccttctttacaagaccatcaacaatcgagttaatggcatcaaacattattgatccttatcggtcggtgttagtgttccctgataactcatcacacgaagagtttttctcaggctcttatcatctgttgcttcaatctgagcctcaagacttgcacagcctgtagccagccaagcagcgtccagacgttcaaacccttctacacggatgccgtagtattcgatcttattgatcgtgcgatgattgcacgctacaagctcgtaccccagctttacatccataccattcgtaaacagaatggactcaaagattttcttgttgtcaatggcgacagcttccgcaaagccatcaaccatgttcaggtcatagaatgacagtgcgtaatcagccactgaacacctccatggaatcaaatagctcgcccagttgctcaaggcaagctttggtattgggcaggtctttctcaacatccagaccagcagcctcagctacagcccggtactcttgaagcatcaatacgaagttgtttacaaagtctgggttcttagcagcccagctgccgacaaattcaagcagttgttcgttagtcattatttagtctccttcggagtgtaattcatacatacgttatttgggataagctgacgatgttgtgtccagcctcggaagttgccggaccagaagttacccttatcgtcaaggtgtgttgtacccttctcatactgaggctcaatacctttcagcactagctctgtccactggtaaccgtaaacccacaccatcggtgtagcctgatgttcgaatgggctggcatgtaccggctcactctctacaaggcgcttatacaccatctgagccttctccagcgtgtcatccagcttacggtagctcacttgagcacagcagctagaagagattgccagagcgttctcaaggctatgtccgaacgcatcaacagggaatgcaccctcagtggagcgaactgtgctgctggccttccaaacaccagagttgtaatatggaacgtgccaatcacccggcttcaactcattaggcgtgctcgcctgcaaagcttcccacatcaaacgtgccaactcacgaatctctggttgagcgtcagcatggttacgcagccaaaagaagttgtccatgcaagtagctgtcatgacagtcttcattgtctggaacggctcaaggatacggtttgttgcttgcttgtgcagaccaagctttaccattacctgtgcccacttgacagcagcttttgctgcggccttccatgcccacttggctcctatctgaagtacaggtgaaagttcattggaggcttgcattccagattggttagctccccagtgaattggcattgccggattgtcggccacttgtttgatgattgtgtctacgggaatagcccgacttgatgccgcattacgtgagaacagacgatgtgtcatgaactccccgtgaatgaagcgttgatactccagctcccacgtaacaatcatttgaccattaggtgcgatggagtgagcgatgattttagctgtaatggtcatgaactctccttataaaacaaagggaaaccttttaacgggtttcccttaggtggttattgcctgtgtaggacgttattatagtccttttccaaaggccgtgtcaagcctttactgaattctttgtgtaagaatcatctcaagctcagccaacacgttgaaagcttcgtgggccttgtggagtagtttactctcatggtccacaatgtcaatcaatttcgcaccaccttgacgctctttgttgtgttccatcctgtgacgtgatgccgcaccttccaaggcgttctctgcgtctggcaggttcttccagtcatgaggcttgtagcccttcacgtcacccgcccaagtcataaccttggagatttcgaagatggcattagggaagccttggtcaaacaggtgaaccaagattttgccgttcttgcgtttgtccaaatcaggctggaacacctgctcagcagacttgctaaccatgtgcgagctatcaaacaacagaggcgaaagttctttctctctgatgccaacctcaccttcaccaaagtaaccatcattcttatcgccatcagaatctcggtactcaaagtagctgctgtaagtgtcgtcttggaagtctaaagtcctgatcaaggtgtgtccatagtacagacgtgaatttccgatatatacagcctcagtgccctctttaaggtccagaatctcttgcctagttagaactctcacattcattcttctttctccaatacagcgttaatcggttggtccagttccaaggcgtcttcaaggatagccttggcagttgccagcttcagcagcaacaccatcagttgctctggtgtgtcgccgtgctcatcaagcagcttctggaggaagctgtgaagctcagttggatcgatcaaatctttggcattgactacgctcattcggattcctccaaggcttcttctgtggattcaagaaccaccttgagcgaggttacagccagctcggggttctctgggaagtgtttctccatcagtgcaaggatatcgaaagccagattggcctgttccagtgacagcatatgtttactcactctgttctcctttctcattaattttgttgaagtatctgcggatggtgtacccacgtccaatgctccacactgtacagccgatagtggcgacagttgcagaaaccattggattcgaccagagggacaggcaacccatcgtaatgagccagcttcccaccatgccaacgcctgtattggtcatcgtctccttgagagactgtttcttactctgagccataagccctcctaaacgaatgaagggccatcatacgatagccccgattctatgtcaagcagtgtaacgctctttgaggtaatccagagagataggcatcggaagaccaaatccatcatgcacctcgttcaacaccatcaaaccacggaagtgttggttgccttggtagcctttgtaggcttcatcgtgagggtagcacgcaccattgataataccaatgcgatacttgccgtcaagttggttgtcagcaatggcgatatccagcacctgcttgtgaccaacaacaaacgatccaccaacagccttgatctgtgcagcggcgttaccagcacgaggacgaccattcatcgggttcatcaagtagtgaacgtaatggatgccatcaatcgctacaggcttcaggaatggaaacacttcccaaccgaactgctctagattaagtgtggcagtacccacaaaaccgtcaagctctggattatcgtttgccatccggtcaaagcgatcttcgtggttgcctgtacagaataccatgcgagggctatacaccttcttcttgtttgctctctgttgctcttgcaggcgtttaatcgggtcagtgagacgacgcatgccttccatgccagcttcgatatcaagtacaaggcgacgaccctccatggctttctttcccttgtcatacgaactcagagactcaaagtcaaagtggtcgccaatgtggacaatcacgtctggcttcttctctgcaatgtactcgccaatatggctcaagtagtccaacgatgtacccggcttacactgggtgtctgctacgatcaggtggcgcttcttactcacttcaaatcctccttattctctttaccttctttgaatgtgtagtacaggctaaacgcgcagtgtacaacactgattacgacgcccagaccggcgaagaaccctgtcatgggttgtgcagcaataccaaacagcagtgccagcactaggtgtttctcagaacgttcccacattacttaccctccttcaatagtcttgtcacctgctcacgcctttctttcactagacgtgcaggagtttcacctctttcgatgatccacgattttacctcattcgctgtccctttgcaaatgataattgcctgtttctcgattgctgcatcttcatgggacataccattacgctcggcaagggtttttatcttgtggcatggcttgcacaggaatgcaaggtcttccttacgaacgaagacaatcccttccacaaacttctgtacgtcactcacattcttcagcgagtgctcgcctgtcttgtggtccacttccatgttcttcaggatgtgttctttgttgcaaatctcacagacgccgccccaaacctttggcctgcctttacgcagcttcacgtttgggttggtaatcatcttgcgggcttccttgacaaactccagtttgacagggttcttgctccagaggtaacgccggattccgccacgaatccagctcaagtacattgcctcagttttccagatgtgcgaatactcaacccaaggcttgaaatcattcatcaaaccacacccagcttatcaagcatggcagctacgtcgatgcggtcatcttcccagcgtctcatgtgggcacagtcaaagtacatctgcataatctgcaaggcgtctttggtcaccatcactccatgatggtccatgtacgtaaccggctcaggataccacgctttgtattggttgtaaaccgcctgtagcgcttccttatcgcctttcgcatccttgagaatgttgtacgctgccacttcaccaaacgtcacactcttacctgctttgtcctgtgcaatcttccagaggtcacacccatggtagttgtccacagagtcgccgtagagcgcttggtagtagagccacatacgaccagtacccttgatgcctttaccctccttgtgcagctctccaaagcctttaatgagtacaggcttgatcatcttctgagggttccagagccaaccactgcattgcagggcgtctttgtcttccgtcacttggataatcttagtctcactcttaaagccttcgtatgcacgaatagaggatttgtcatccacttccataccgttgatcacgattgcacccaactcgctaatcatgaacgctctcagctctctcagctgcaaagggcgaatggtgtcttccctgttctctttgtacttcccgcctaacttactctggcctgcccacttacctactgtggcaacatgagtcattggaagttcaatagtgtctcggaagttgttctcaccaccaatgtaaatctcatgtgcggtgatccctgttctgttctggtagcctttgatcatctcccgaatcaaggtcttgccgtagcttgagtgacgggcctcttgcacgtccgtgatggtgtacatatcctcagtgtgttccgtgtccttgatgtaagctcggaacgctgtacggttatcccagtgctcaatcacacccttctcaatgtgttgggatgtaatgctctttgtttcgtttgccgctgctgccttgtaagcaatactgtctgcgtcaaatactagaatctctcctgccattatgtttcctccagatagcaaaatggggcacgaagccccaaattgttcaatcagtacgctgaatcaaccttacctttgcggccagtgactcggatgtaagtctcttcaagctcacgctgagcttctgtgcgctcatcaaaggcgtcagctacgtggagctttgctgaggcttgtagaagtgcgatagccttcttatcgaagcctacagcctttgcgtcttctttgattttcttaacgtcttctttttgtgccagagagttcaactcttcagttacaaacttgtcaaacagttcaaattcagtcattgaacaccccctgtacggtaagccatggtagatgaggaagcccgcaggtaggcgttctccattccctgtgcgtcagccatgaagttcatggttgcaccagcggcaaggccaaatgtggaggcaacttgaatctcatcaatgttggcagcaaggaacacaacttggtagcctttctcttcagcttgtttgacaagctctttcaccttgacagcgttgtactcacgcgaggcgttttcataaccgtcagtgaagatgttgatgattgccttttcagggttgtctttcaacaccttggcaagagcagtaccaattgcatcattcatggcggtcataccacccggctgatacagcgcttcggtcaggtcttcaacttgatccagtgcgacagcatcaaggacaagattaacttggttagagaaggtgtagagggtaacgtcagcgacaccagccactttacgttgatcagcaatcagggtattgaaaccaccaattacatcttgacgaagactagccatagagccagattcatcaatcacgaatacgatttgtacagcatttggatttgtcattttctctcctttattgagatgtaagcaggccaagaaagccccacaggaagtaccaacccagagcgatgttgacgcccggtacaacacagtcaacgacaacgcagacccagaagataaaccagaacaggttcatttatcgctccttagaaaatagtgagggcacactatacaagctgtgccctttggtgtcaactcttagaacggaacatcgtcgtcaaagttgtcatcgtcatcagcaggtgctggcttgcttggagttacaccagctggctttgcagcctcttttggtgcagcttgctcgccacggttaccttccaacgcttccagttcggtcttcagcaccgagccttcgtagttgttagcacgcttgatgtggttcttgaccgccacacgcagttgcttgatggcttctgggtcgttagctgcgaacaggttaacgaggtgcagagtgccttctggagcttctggcagtgggatgccttctggaaccataccaaccagcttaacgttctcagtgaagaactcaccaccgtttttacccggcttcatgaacacttgcacttggaactgagccactttaccaaccaactcaccaatacgatctttggtgaacagaccgttcttgtccaagataccaacagcatctgccagcttgtgcagaccgttgttcttggcgaacgcccaagtagttttgccaccgccgatatcgtgctttgtttcacgaatgttgtatggcgaagcaacgatcttggtcttgtcacccggcagagtgaattcacggttcagcagaacgcgcagtggttgcgggttgctgttgccgaagaacttacccttgtcaaccatgatctgagggaagtcgatcatagcggccatttgctgcactggcttttgcggccagcacttcagacgtgcaggcttacccttctcatcgaaaccatccttgaagtaggtcgcaggcttttcagcgatggccttttcttcatcagcggcagaaccagtgaacacctgttcagcgtcttccagattctgttcaccgaggtcgatgataccagcaatgacgccgggaatcgagcgaggtttgtcttgggtcttagccatctcaatcacgtgcttgttcaggccatcccaatccacttcacggcgctcgccaccagcgttctgagttgtggtagttgttacaaaagtaaaagcagtcatcttatatctcctatctagaacccattattgggcaatgtgaggtcacttgacctcgttaacgctaatgatcagttagcgaatctctttggttgcagagcattggaagatacgaatccccttacgcttgccacccaatgcagatttgatttcacgggcataatcccgatcatcagtggttgcatacacttcgtccttggcattcaggacggcgtatactaccttagttggtagttcgctgtcaactactttctcgacagctttggtgtcagagatgatttcgtagtgttctggcagcaggtattgactgaagcctgtctcatcaacaaacaactcccaaactttcataccatgaaggaagctatcgccttcgctagtaaccacggctcccacatcgaaaccatgacgctcagcgcgattaccttcattgataactcttacctttgtacctattttcacagatgtacctccttcgtgtatagaatgcgtatcttactctggtttttcttgggtgtcaaccactaattcaacctcatcttcatgaagcctttgtttgatacccttgtcgttgacatagaggtgagcgccgaggattgccccggcgctgatacgttctacgatttcacccagagcgtacatgtggtagttgcttttgctgactaccttatagaatctcatagtcatcttcgtcaaggtactgaatgagttcgccttcttcgtcctctcctacgaatcctttcagaatccccaaatcatttccgttgaagactacaatactcccttttgcgaagttgtggcagccttcaggccctgtgatgactcgcacttcagtgcctttagtgatcatgccagcagctccgcgaaacggttcttgacgcgctccagacgggagtgatgctcatcagctacagccagttgacgttgacgggcagcaatctctgcttcgtgctcagccttctggacagcgatagccgcttgggcttgttccagcttggcctgtgcatcagtgaaagcttgcagagcttcgttagccagagcgtcaggggttttgcctttcttaccgccgaacaggtcagacagtgcgaattgggaattggtggtgcctacggatggttcggtacgagtagtcatggtgttctccttttatgaattagtagttgcttttggtgcagattgcagcagttccaaccagatcactgaaatagcgcttgctctctgggtagacataatctacctcatgaacagtccacaggctaccgatttcaaccttcttggccttctcacgtgaacaagacaggcgctcatctttgtaaaccttgccagtcttgacgtctttgagcgttaccttgctgttgctcttgctggtcaagtatacgcttgtcacttgcattgtcaagaccctttcaccaattttcttcggctgttcgaagcaaccagtgagcatggctgcacaagacagaacgaacgttcccaacagtagacccttacgcatttgttgcctcctttgtttgtgtgtggcgattatggggcttccttgccccgttgtcaacaccttagtgaatatccgaatatctttgcccaaattgtgtttcacagtccagcttacggcgaaggttgtaatccttgttcaccttctgcacagcctccttgatgatcttagcaatcgtctcacggttcttagggctgtcgcccatgcagatgatgcattcgtcgtggaacgatcctgagagcgtcttacggccaaacacagcttccattgctgtgaggatgttgtcaacccacatgtcaaagaagaacgagcctgttccctgtgccagagtagagaatcggtcagactctttacgcaagctgtagcagaacccgttgattgggttgatcagccacttgtcaccacgactgtccttgaacaccacctgttcatctgcaatggccttcacagaccagttcagttcccagtaagccttgtgcaggatttgaccttcttcaagctccacaccagccgcttgagcaatcttagccgcaccagcgttgtacacggaagcatagtttgtggtcttacccttcttacgtgctgcaccaacacggcccaacaactctttgtcagcctttgtcagctcatcctttggcagcttcttcagccgcttatattcgttgaactcatactcatcaatcatcttagcaatgagagccatgaggacgtgcgggtcgaagtcatcagcctgcattgttgctacgtactcagggtcatgaggcaacatgaagtggtgcttcacacgatcctcaagcgaggacatgtcagagcctaccaatatcttcctgaagccagcaatcaaactcccacgaatgtcgtacccataaggcttgtcaacgcccggaaggtttaccagttcacggtgtttcactcgaagggtgtttgtaaacccaccaatgcgagccttcagccactgtccatcttccatgtccctgaagaagcccagaagcatgttacggcggttctctgccaccttgtagtcagcgtacaccttaatcgctggaacctcttcagcaagctctgtgagcgagtgacacagctccttaccatcatcaccacccacagagatttgtgggattgcacgttcctcaggacggctgttcttccagcgttcccattgttggtgcgtggctttgccttgaggcttgctggcaatccatgcgttgaatgctacttcatccttctcgtatttgaaggactgaggcacccaacccttggagaacaggaagtctttaacctgagcaggactgcccggattaggctcttcgttcttgttccacactcggtaaacttgcttaccatcaactggcttgtcttctgggtcaatgtacaccagaggtttgccagtctctgggtcaacttcaccagactcaagttgctttagagtttcgtcccatttaatccagtgtgcagctcggtcaccattcttcttgaatgggtcaatctttggctctgtcttcttggcatacttcgacacctttggcatgacagcaatcaagccttgacgggcttccagtacgattgcttccagcttatccagagactcacggcaatggtcgaggtcaaccatccaacgggttatctcttgcagagcggcacagtccatcttgaacatcaggaatgtgagaatgctgtcaatggcctgatcaaccttacggccaaccatgtcatcgataggaatccactcatcagcagaaatacgtgtaccgcccacgcgggtgatcgtcacgttcccgttcttgtcctcaactcgctgaccattatcaatcaggtcttgagcctttgtgtacatgtcggtcagacgttccatgtggtctagccacagagccgtgttgatcttcacgtcttcctgacagcggttctgcatcacgtcaaggaaatctttcagtgattgatcttcaccctgttcccagtcagagactggaggcttggcgatgccgtagtcttcaaagaagctgtccagaccatgcatgttacgatcaggactcagataccacgacagtgcgagcgtatcaatcaccatcagctttgacaggtcgagtttcagaaccttctcaaccatgcgaacgtcatagccaataccgttgtgcatcacaacaggaatgttcttgtcaatgtggtatttgaagaactttgcaacacgctcttcatagtttgcatcgtcacggcgaatggtgaataccttggacagctcgccattcatctcccgaatctggtaagacatgacgtgcatcttggttacgccgtgcagcaggttgtctgcctcaaagtcggcaatactcgcttgcctccagtttgtaatttgcttcattgttcctctccctaaaacgactaaagggatgataccgaagcaccatccccttgtcaacctacttaatactgtggctcgtatacaacccaacccttctcagacaaaccacgtttcgggctgcctcgactatcatcatcacctccttggtcccgcatctcatactctgccttggctctcggattccgttcaaggtaatcgtccagatcatgcagcgtgtgagtagcgttgtcgtagaagtatttcccagcgttaggacttgtgttacctgtccagcggcacttggtcatcttcatactggtgacgttacgctccacctcgttctcagcttccttgttacgtgtgaacaacaggttacaggcagcactcttgaagatggcagacgacccttggaagtcttcttcaaacaggtctgcacctgccgagttttgcttggcaccgtttgcactcttacgcacgtggttgatcaggatgaaagaaacatcatgactcttcacagtacctttgagccacttcataaagacagcctgctcttcgttgctcataccgtcgagaatgtcttgcagtgggtcgatgatgatcaccttacactcacaagcgacgatcagttgcatgatcttctctttgatatcctcaatcgatccgtcacgttcttcaaccaagtgccagcggtgcgagccgtcaggcaggaagaacaactcttgggccttggcttccacctcagcgctgttcagcaggtcaatcttgtactggtcatcttcgatcaggtcaagcttcttgccgatgtgacgcgacagcatcttgttaccgtactgagcacagtcactctcaagcgacagaacacccggcttgtgtggactgtggaaaatccagtggtagacacattcgtctacaatcgtggacttgcctgtaccagacgccgaacccaagttggtgatcgtcttgagcatgataccaccagccatcatcttttgcactttgtgcatgaatggcggcaatggaatctttggtgtcacagcagcagctttcatcaacttcatcaggctaccagaaccaacaataccacttggagtgtaaggagccgccttgtagaaggcagagataaactcacgctctttgttgctggcctgttgcttctgtgcatcccagatgtagcagttcgggtctttgaggcccatttccatgatgaacgctttgcccttcggcagtgctttacacaccttctcagcggcttcacgtccagcagcgtcattgtccatacagacgatgatcttctcaaagcggttgaaccactcatactggcctacaatctgcttctcacagcctgtctcaccaatcgtaggagacactacagggattgggtcatagcccttggtcttctggtaatcagacagcatctggaacgcggacagctggtcaacctcaccacctacgatcaagcagtatttgccacggtcacggacaaacttgaactgaccaaacagcatacactctttgcccgtctcgcccagaggaccacggaagtctttaggcagtgtgcgctttttgtagcctgtcaggacaaacccatgatcgttgtcagcttccatcgtgcaagggtaatactggacagcgatatcaccagtttgagtattcacttcatggcgaacaccaaacgctgtagtcgtgtctttgcgaatcccacgataacccttagagtcggtcgtggtgatttccttcattttgttgtgaatctcatcgttaaactcagcacccaaaacactgtactccttttcttctacaacgccattctcttcaagccattcttcagatggaatagtgaagccaccacaccctccaaagcaatgagcacctttatgccgtccaacgtcatcagtcccgtagaccataagattgtcttgcgatctgtctccacccttctctatacacttaggacaacccaccttcccgtatgtgtacaggtcaattccatacttctcagcaatatctagactattcactctttcctcccatgcctatctgtataaccctcggaaggtacgcacagcatatcctttctaagctcacttgccaaggacttcgctacgtcttcgccatatttattacaagagaagtgccgttccttggttttcccattttccctccatcgtgcaatccagtagtcgaaaccctttaccgtccttttaaagacgcatgtttcacctgagctgttagaggctggcatgggaaggtttcgcatatttacggtatgtgtaaccttcctaaggttatcgatcgagttattctctttattgccatctatgtggtcaatctcaaagccttcctcaattggccctacaagaagaagccacacgagtctgtgcgcgtaatacttaacccctctgtgtctgactacccagtaaccacttctgtgtttgtagccagctacctttatacctctaaacaggccagaagggctatcagctgagtaagtcaaactggtcaagctgctctggcctccgtaaatgtgtatgtgtcaagcactggagtgcccggtgtaccaccgcttggtggggttccatcgccgccgcctgttggtggcttagggtccggcttctctttgtccttagcacgtgctctggcaccatgtagcatgccaacatacttgtcctcaaactctttggtgattggcaccgacagaatcaaactaccattgtcctctggacgtacagagaattgcaggctcttcgactgctggacgaacgtcatgacgttgtgcaatcccagaatgttgagcatcagaatgttgccattcaaggttggcggcttcaggtcttgaggtttcatgcaatcacctcaacttcacgtgcttcgaatgcaagacccgtcaggtcgcactctgggtcttgttctgggtcaagatcgacacagacagcgccgtcaggccacaccttggtgattacaccagtccaaccaatcagattatcatcagaggcatcatagtcatcgcgaccatcactaacaacttccacacgatcacctactttcattcgttctctcctttcttatgcttacgtttgcgacggtacttggtacggtcacgttcaaccttcggaacgttgacacggcggttaggccctgccagtgggttgcgtatcttgtccatcacctaatctctcgtatccattgatggagtgctgcgtcaaccacgtaatggtcagagcttgtagcattctcgatgtgtaccagatacaaaggcccgtgaagaccttgggcggattgtacacgaacagtgaagctcttgtcacgcagtcttacacgcttctcaagctcgtcacacatattgaggatttggccttcagtaatcataccagtgacaactccttctcacgttgaagctcttcctcttccagaggtggaataggcattaggtagtttaggttgaagtttgtccaacccttttccatttgatattctccagatagtgtccctcccgtgacacggcaaccagacacgacagcagtcctatccgcgttgacaatgactctagaactgccttgttccgcacctaaatagaagcttgttacgtcctgatcagcttcccaaatatcctcaagggttaccacagtcccgatcaggaatgcgttctgtggttgtctgacgcctatgatcatgcacttctggcctatcactagctgattgttgaactgctgcatcctacgtcctccgttgttgattgtgtggattctacacccttatcggcgtttgtcaaccctcacaaacaaaaagaccctcaagccagagggctcaagggtcagattgggttcatgcttacgacagctcggtgcattgccagcgtccgtcacgcagatacgtcgcaacgtgtatccaagatttggagaagcttttagctgtatactttacaaatttaaaagactgaattgccaacggcatgatctttcatctttgcacctttaaagactgatctttgaacttagtcaatgcgagtctgcccaaggttggcgggcaatctatgcttagattaggttgaaataccattcaataataggctgctcggatatacccccgagcaatgggttgcgtgaatttaggcaattcgtcgcagcatgagaaacttgttacgcctcgatcagagtcttagcgttggattccgacagaacaaaatccacttcaaacaggaagccattgatggccgcttccatgtccagaatcaccttctcaagcccgttagggtcgagtggggttgtgatgttcgaagctgtgtaaggcttgctgatggcctccagctcgtcttcagtggccttacgctccttgccaacagctgtctgaatcatggtgtcgattcgttgttgcatctgagcgttgttacgctctacaaccgaacggacttgaccaagctgctgttgcaggacggacataagagcacgctctttgtcgatgctacccttacgctcgatggcctcagccacagtcagctctacgccattgatggtgaccgaagtcacagcgttcgaacggatgatggcagccttaactgcttggcgacgtgcaatcaggtcttgaacagactgaaggttggccttcagagtgttggttgtggtttgcaggtcagagccattggtagtcttgccaccaacagttacagttgcgaataccgattggcgagttgccttttcaatacggtcgttcagcgatttgatttcagccaaagcgcgagtgatggaaatctgtgtcataatcttctcctttgatattttatttggtcattgtagcagcttttcagcctttgtcaaccagtttgtacattgtatttcgtgtttcgatgtacgtgtcaccgtcaatctcgacgatctgcttcacagtggacgtgcgcacacggtcgccgtcgaggaagatgcctcgcgagtcgttgtagatgaacccatgggccacagtgctgccggggaacatctcattgtcaagacgctcaaacaccatctcagcaacaaacttgtcttctggtttggcgtccacaggcagaatacgccagctggagtcaccaaagaactccttgacaagattggggttacgtgcttcaaacaactcgtccagctgaataccactgttcataaaacctccttatttcgtttcagggtagaagtatacacggttctcgcacagctggcaagaggtccagtaaaaagattcatgaaaatcagaatcatatgtcaagtctccctgttcggcacgatactcgctcttgcaggtggcacacttgcctgtgtacttccgcttggctggcagctgtccaatcttggtaatctcgatagccattattgaaacctcatcattgcaaattcaagatcacgaacccggccatcgctgctcacctgacggcatactcgcgtacagaagtcaaggcacgtctctttctgtgctggctgcatgctgtagttgaggtctgccagtacagcctgacgttcactgatccgaagctgtgtaaatgcgtgcaacaattcctgagtcatttgtattctccatttctgtatttcatgaccaagtgcattctcatacactcataaccaatgggcacacccactgaactgacaagcaccttaccattaccacctgaccgaatgcaagccattttgtgatcatcgaagtgatttactcttacgatgaacaggcttccaaacattgccacagcaaacagcaccagtcctaagaagaatttcattgctacggatacaccctgaaagcaaacttgaccttacggcgagggccgtatttgtgatcatgcaccacaccatcaatcactgcaagagcgtgtccagccacaaagacccagtagcggccttcaggatggttcttacagaactgtgcaagcgtaggcttgtcaacgtcaccatactgacggccagtcatccttgtctttgggcaccgtgcaatggcgtcacggcaattgtcagtgtccgtgcctcgacggttacggcgtccaaacatcttcttgatgtgagtgtgtgcagcttggtaaggagcaccccaaacctcacagaaggacactacaacgcaatcggctctttccttcatcttatcgcgttcttctttgtacttaggccagttgtttacccatggttccatgcttcagtcctcagagttgtgggttgctgccagtgccgcgtgagtaccagaatctgtattccactccgtcaaccttacaggtcgaaccccttgccgactttccgtcactgcccatgtagacgatgtactcaccgcctttggaatggcacacggtctttcttatgttggactcattaagtgacaaccggccctcacaacccatcaaaacgccacacagcaaacccatcagtacaatctttttcatttcattgctcctttgcccatcggacagctctcttgataacattcccatgacagggattgggagcacaatagcaagcgaggcgcttcccgtcaagctctttcaacattttaattgtgattgagccttcctttatctgcttccacaaccaattcctgtaggcttctattgcctcagcgacagaggcaaccacatattcggccttcgtaccttctttatggctgtacgggttaccccagatactacctcttcctatgtacaccacatcagggtcattcctattgatcttccttatattcaccacatggcacatatcttgctcctatccaaaatgggtttcgtattgtcgagataaaccaatcccaaggctcgccatactgatcaacatcagcctgagacgtgcctacaggtttatctctatgctatccaaaattgggatcgcaagtcggcagcatgggctgctatagattgtggtccttcctctatgatagagtccgctgtcctgttcccacattcaacctcaggtgcccctaacagcttacctcttcatagggcgtacactcgcaggacggtgagggaggtctttcgacccgacatatctctctgcgacgtgatgaatgatacaccacaaatttttcttgtcaagagggttgactcgtttcggatttcgtatattctggctccacaccaacaaacgaggaaacaaacatgaacactgtaaagactgacgccgtatccaagcaaatcgctgcaatgattcgtgcaaacggtagcaaattcttcggcgtgaccttcgtcaaggctgacggcactgagcggactctgaacggtcacgttcgtaaggtgaagggtcaagatggtcgcaacaccacatctcactatgagaagtatgtcaccatcgtgctgaactcgaaagatgagaaaggccgtgagcagttccgtaacgtgaacactgaaaccatcaagagcctttcgattggcggtcgtaaaattaaattcgactaaccgcttgacaagattctgaaacactgtagactaagccacctcaaaacacacaaaggagaaacaaaatgagtaaagttactatcgctgctgctgtaatcgctggtatgaacatcgctaagcgtttggagcacctgcaagtacgggacgatgtgttgatggatttggttggtgagttggctgattcgcttgccaacctgttggaagttaccgctctggtagatgagtcgattggcctcgtggctgacctcaagctgcgtgagcaagaagactttgcaatggcaggtctggcccacatcaaggcagtcacctcggaactggtttccgatcaagacaagattcgtgagacattctatgagtctgtgagcgatgaagagcgtcttatccttgagttgctgtctgctctgcaaggccggtaatactcaaatagccctcggtaacgggggcatttttacgactcaaattttaggagatttatatgtctgagcgttcccttgcccgtgttgtgacaattgacgaactgattgccattgaaggcgctgaccgtatcgaactggctatcattggtggctggcaggttgttgtacagaagggtttgtatgtgcccaacatcacaaaggctgtctactttgaagtggactccctgcttgatactgagcgaccttacttcagctcgctgagcggcctgtcgagcaagcttcttcacgttgttgatggccgtacgcacgcacgtatcaaaaccatgaagcttcgtaagcagctctctcagggtttctgcattcctctatctgagactggcattcctgaggataccgagcttggtgcagaccttaccaaagctctgggcgttctcaagtacgagaagtctgaagaaaaggacatgaacaacactggcggtgttggtgtgaagactggcaagtctgctctgggcttcccaaagttcattccaaagactgaccaaacccgtgtgcagaacatctctgccatgtacctcaaggctgtgtccgaaggtgaagagtttgaagagtctttcaagcttgacggtagctcactcactgcttgggtcaaggacggtgtagctggtgttgcctctcgtaacgttggcttccgtatggaagatgagaaggttccgttctggactgctgtcaagaactggttcctgagtcgtcgtcctctgatccacaaagagtggaagcgtgttatcaagaaagacgataacgcattcacacagatggctgaagaagctggtctgattgaagctatcaagcgtgatggccgtaacctcgccattcaaggtgagatggttggtccgtcgatccagaaaaactttgagggtgtagattccaacaagttcttctgctacgatgtgtacctgattgatgagcaacgctacatgctcccacaagagcgtctggacttctgctctgaccaaggtgttgtgcatgtcccagtcaactacactggccctctgaaggctgtcacagtggctgaggcgattgcacgtgctgatggtccaagtggtttgaaaggtaagtaccgtgagggcttcgtctacaagagcaccaagcgtgacttctcgttcaaagtgattagcaatgcctacttgctgaaggaggaataatcttctgacaacaaaaagcccgccttccttagatataggatgagcgggcttcaattgcttcttcttctgtgtcgtagtaaccgatatgcttcttcttgccgtccttatgcatataagctctccacggctttggctttccttcgtagtacatcacacctgcaccgggttttcgtctgttggaacttcttcgcctcacctttgttggattaccaatatagttccacttaggcttgtgctccgatataagctccgactccttcagtgtagcttctaagtcagtctcaaacctgaaggctatgctcacatccatggcaataccttcgaagtgtgccttgttcaagaagtagttatggcttgtacctgagttgacatgctcaaatcgagcgccacttcccttgccgatatagacaatctcgtctcctatctttacaacatacacgtaatacttcatccccactcctttgtaatttgttctgattgcccgccgcctgtcaaggtgagcgggctttcagcttttcgtgaattgcttgtatatccagtttgtttcttctaatatcatcttcaagtagttctatcctttttctacttacaaactcgttagagtttagctgttcctccaagcggttgagtttaatctcataatttctttccaacctagaaatatccattctatagttttgctcatagacagcaagtctgccgtctacgttacttctagagaatgtaccgcttgcgagaagaccgatacagacaagaagacagataaacaatgctgctactgctgacaacagcgggtagttgcgttctcttgtcattacagcctccaataaggtattacctcttccctctggtgtcctcaagaatcctttctagatatttgtttgtcagagcaatctcaagtcgaataccttcgaatctagagttgaagttgctttgcatcctctcttccatgtctttgagtttagcctcggacacactctctttttggagggcgtagattctgttttcgttttgactgatttgggtttgctggaaactgacaacggccatcataactgtcaggacagctcccgctacccaacttagtatagtttgcatcattgtttagtctcctttccaacttccgcctgctgcttgtagtaatctgcaatagcattcaggcggttgttgcacttgtagatttcagtggtgttaatgatgtttgcctccaccaaggttttgactttattgtcacttactcttgctggctggcagtttcgcaggagttccgctgggggtgcaataactatcgtctttggctccagcacagtacgcactgttgagcatgcgcataatgtcagcagaaaggcgagcatcatcagccactgttttaggcttttggttagcatctatgattgtctccagtaattggtcatgcggctgtttggcgagttctctcagtgtcaagttctttgactcttcaagtgattcattcgcctctgttacgacttcaaccttttgttggctgatagtgcaacgtgtgttagccagcacttcacggtcaatcgcttcctgcgttctatccttccatgtttgtacgttctgttccagcaccactgtcgcagcttctaatttcttaacttcgctacggtagtggtagctggttccaaacaaagagactacaagtgcaaacagaatggcgataatgtatttcgtcattataactcctaggtcatatagacctcttaaacgatagggttatctttaacttctacgccagtttcggcagcttcctgctcatcctcttcttggctagctgttgttgtcatgtagtagttaagccctgtgcgaacaactgcaagcactgtagcaatagctgcgtatgttcccggtggaataactgactgccacaacatcatcaacggttcgatggctagaaacagcacaacgaagaagccaagtatgatggacgtccttgatttggttttctttttcatagaaccctcctgagttctttaaactatttggaggctacgtatgctgcggcaagtttactatcgtattggttgattttgtagttagcaccattgtaaagcttggcaactgtagcccagtctttagaccttagtgcttgcttgagttttgcattgctgttgatgaacccgacgaatgcattcaactgttcatcttcactcttatacatagcgttgacaaaagcctgaatcgaagtgtatccacattccttgaagttgaatcccatcagctggaacatgccccaagaacaagactgcaaagcacattccctgtcaatctggactgccctgtccagtttcccgtgttgctccgaaaacttaccatacccacccggtgttgtgttcacaaggtcggaaggtagacccactgtagagatacccttggctttgagtagccttgccatgatatgtctctcgtagaggatttgaggaacgcccggagtaatccaagcgctaccttttgtttcaacagaggcgatggccttgatagcggccacctccactccgagtttagcagcagccgctgcaaaggcttgttcactgatcatattaaactccccaaacttgccacataccctcgcgggccgcagggtcgccagtacccttctgaacgtacataccgttgccagttacagagttgtagcccaactgatcggtagcagcgttggctggtgtgatgttgatattgaagattgtgctgaattgtgttgagaacgaaacataaacacttgcagcacgagcagcaccaacagagaatgtcccgtaggccatcttcactccgttagggaagctcataaacccagactgtgctccaatctgactggtgaagttcagagaaccaaccacgccataggcattcatcgttgccgctgacccaagtcccaagttgtttcttgcggactgagcgttagccaaatcaccaaggttgttgttgcgttgcagaacatcgccaatgttgtaaccaacgatgttacccagtccaaggtttgcacgtgcctgagcaacgtttgtcaaaccagctaggttgtctgactttaccatcaggctcgccagaggtgttgtggctgttgactcaaggccaaggctgttacgtgcagcagctgggttaggcaagtcagcgaggttgtaagccgctctcaggaagtagttctctggctgggtagctgttgaagtgagtccgaggttggtacgtgcttgcccttggttggtaatgtcaccaaggttgttcgcagctcgcaggaacgatcctgaagcctcagtagccatagtaccaaggccaaggttcaaacgcgcttgtgggacgtttggaagccctgcaaggttggctgttctcttcaggtagaccgtggcacccttgagaggcgtcacaaccttcgagtcactgacaccagcctcgacttcagccatcgtagcaatctgcacaacacctgaagaagcttcagttgcttggttaagcagtgaggccacttgtccgaggcgtacagcatgttcaggttgagttgcaaccccaacagcaaacacttgacttgagttaccattcaaacttgcaaagcgtgtgtcactttcaagcttggagtagacagacaagttagcacgagcaccggcaatgtttccaataccagccaatgtctgatagtttgtgatgtgtgcaacgagggccgattggacaacagcaacacttccgtagctttcaaatgccagagtccagtacagactattcaaggcattcgctgggtctttgttggtgtttgtctgtaggcacttatagatgagtccgtcacttccttgtgtgtagctcagcagtccttgatactcagtgagtgcgtcccattcagggataccatgctgactaatgtgagcaatggcttggtcttgacggttgtcaacccagttttggtattcgtatggtggaagctggacaacccagccgatattgaccttggacgcacccggatcaaccttcgtaccaccattagcccagatgttgctaaggccaattggttttgtgatattagccattgtgtttcctctaattaggcatcaggtgccgatgggcgagactcaaccgaagggaatccttcagcagcgggccagtttctcaaagcaacacgatactgccgccatggtttagactctccttcgatttcgaagtcttcaattttgttgattagaacatcagcacgactcagctcaccatcacgccaaacgcgagcatcgtactcagcaatgatcttgacagaagggtcttcaactttcttgaagccccttttcttaactgccttatcaatcagagcaagtgcttgagctgttgtatcatgcgggcatgaagggttggctgtgaagggaatccaaccgtagtctttatgattcgcctcacagttgtacacgccttcagagacgatggtgatgtttcttacttctgtgaagattggtgtgtcaacagcctcaacaggaggctggacaatttcttctgttactacttctacttcgtcagtcattatggactcctgttaagcgatacgttgatagatggcaacaccttggttgttacagtaccccaagattctccatgtcccgtttgcagcaccaccaccagctgtgttctgggatgagaatcgcaggttggcaccggaagttgatgagttgcttgtagtttgcatgacagtgcctgtgaggttctgcatcagagcgaacgagccgatagagtcgatattgatgtagtccacaaagcgttggcggaagttgcttgtggtaataacgtagttgttaatccagtttgaaagccatccgccccatgtagtaccgtagaggttaccatctgtcgagacgatagcaccgccggttccacctgcataaaggcttccatttgcgataatgttaccacttgaagttatactattcccggcataaatttcaccgctacctccaaatgtcaccctaccagtttcaactgtgttagctgcgttgacgttacggaaaatgaaaccacctgagccacttccttggttgttgatgaagcttgtagctccaacaccactttcgttccacatcatgtaaccgccttgtactgcggcgtttacgttggtactacgcacgccaaccgaactgaagagtgccccaacaccagtgttaccaccggcaggcatagcacccaagtttgcaactgcctgagcagcgttattggctcccgtaccacctgagctgattgggagtggagtggacaaggccagagtggttgtgtcgataccgttttgtacactcagccttccattcgtaaacacagattgtgcgtacaatagaaggcgaccagctagtccgttgtttgcttgaccactatcaaccgcaatacgtgcatcgacgtctgcgttaccaccaactcccttgaagtcgatataaccgttacccgaggttgtgttacctacttcaagggcaccagcgacattaagaactcctgtaaccgtaccaccagctttatcaagcttggcatccagtgttggctggattccagtttgaacttggcttacaatagaggaagtgttccctgtgtggtagagttcaacccacggttgccaagcgcttgttgttccgcctacatacttacgcaggaaaattcttggcgatgcctcaccctcacggaaagccagctgagtacgttcgttatcgtaagattgatggattacagtgtaagcaccggcagttggaccacctgtgaatggagcggccagcttatagaagcctgtacctgatcctccaaggtcgttcagattgcctgttacaacaccttgttgaccaagaccgaagtcgccagtcttcaacaggcggccaatagtgctgtcgaattgagttgcagtaatagtttgagttgcagcgttacccagcccaaggttgatacgtgcagcgcctttgtccgacacttctccaaggttgttaccaatctgaagagcgttgacaatacgggaatcgttaccagcagctacagtgcctgcaatagtccctgtgttcattccagcagcgttaccaaggccaagtacagagcggacacctgctacgtcggcagcagccaagatgttacgtccaacctgtgtcagagcagcagaaccagcagttgttgatcctgtgaagtaggcaaatgtgtttgcgtctgggtcaacagcggaaagcgctgtaagagttacgtcaagagtttgagcaccaagtgtggcacgcatatcagcaacagaagtatcatcaagcagtgtgcgagcaactggtgtgactttcatcagcgaggctgtgtcagcacctgtgtagtatggcacgaggtcagcatcaggcactaggccacgaatggcttccagtgcagcagacgactcaacaaaggctttaacccagtaggctgtagctgttagagggtcttggttaacgcctgtcttaacgcatttgtagactgtgttgttgcgttgtacataactcttgttgagttggtattctgtataagcgtcccattcagggatacccttttgcagtaggtaggcaatgttgttgtcttggcggttttcaaaccagttccaccattgacgaggaacaacttctacaccccagccttgacgaatcttctcagcgtcaggagcaacaacgtctccagcgacagcccagatatccgtcatgtcatatttaatcaagtccatgtttgttcctttatgtgattaggttagagaggaatccgccttgggtggcgtcattaagatcaccagtacccattgcaccggggaatccgtctgtagcaaataccctgcctgcttggaactcagtgtatgtgtaactgacaccagcaggtttgggaagtagttgaccagcaccaccaaggtcaaagagtagtccgcgttctacgttgttcagaatcttaccgatcccaatacgaacttcagcaggggctgtctcttcaatggtaacttgagatgcaccaaacaagaatttgtaggctgagataacatcttctggtcttgcgagtgttctgttcttgatgatctttgctttgaggatcaatctgtactcatcatcagatggagcacgactaatgccaagcggagcatctagagaataccactgaccaccaacagtagggtcagtagtggaagagaatgattcagcttggatggcaccttcaaaaccgaagtagtagaagatatcagaggtaacgaggccgcgagcacggcctacgatttcaccaatagtgtctaactgagcgccggttgcggtgtcgatggagcgtagttgcattgtgtctctgacgacattctgcaactcaattttacctgagagaagaagcttcagatatttgtcatatactgtcttgttcttgaactgctcagtgacacgagagcgtgccacatccaagaactcttcttcaacaaacgggtttagttcagacatgtaacctccgattatactagggtgatggagatgttgtcagcagagatactagcaacttggtcaaatccaatagggatgttagccataccagttggattaggtgctgtgccaatcttcagagagttgacagcgaaaccaccaacactgttgattggagtgtagagacgagagtagatcacgtcgtcaccaatgaacaggttatcattgaagtagtttgccaagttctgtttgatctgtgctggtgcatcgccgggcataccaccaaggtcgctgatctgcatcgtaatgtagacaggaactttagttggttgcttgtatgaaatgttgtgtaggaacccttgactgtcagcaatctgcactgtggtgtctccaacagaaggaatgcctgttggcttattgtcccagattgattgggccacatctgatggcaggccacccaagacgattggcaagaagctgtgagctggtacaccgttgatatcgacttcagcagtatcgttctcatagatgatggcatctgtaacaccgggaacgtttctgatggcgtcgaggataccttcaatgatgttctgagattgatagaacttgctgttacgaaaacgttcacgaagctcttcgtcagtctcagtcagacggcctgtggtcgcctctacagggtttgatacgctgtcccatccagagataggcacagagatggtatcaatcgccagagcctcttgtgggtaggctcctgtaatgtcgtcaacagcaatgccaagctttcttaccttctgtacttgaaggttgatactgacgtcgaagtcagcgatttgaaaagggtcagtccttgtaatgtatagtctaccattactttggtaagttgtaaaggtgctggacaacaaattgttgattctttgttgcaatccgttcatgatcgactgggcagttgtgcccgatgcaccagatgtgtaaaccacgtcgatgaagttaacgccgtcagtgctgtaactgaatctgtagtctgtgtcatctgccactgtgagcggataaataccaataccagaagcttgcaaggtgttcagggtgacagggttcaagatgctgaagacacgttgtgtgcttgagctgtaagctttaccggctggagagcttacgattgtgttcaagtcaccctcaaggattacctgagcacgtgtagcctgtgcagtaaggcgtgtaatgccgctcaaggcgatgatgttgtctagggccacaccgatagcggttgcaggattaaagctgtcaaacacttgctgtagggcctcccagagggatgcttcagcaggagcgacaacaccaatcatacgacccagagcagagttgtctgtcacgtctacaacgtcaccagcaggaaccaagtcagagaagatagatgcagcagttgttttatagtctgtcagaacgtcatccaacgttttgatttcaagaccttgacgggaaagaccagccatatttagcctccgatagaaagagtgattggcagagaagctgtgttatcagctacacgcacagagaatgtcattgtgtacccacgctgtggtgtcacttcagaagtgaatgtgaggatttcgataacgccgggatcggcagcaatcaacccttggaagataagatcaaccgtactcttcttggtcaccttggtgaaaatctgttgaatgtatggcacgccaattgtctcattcaagaaccactctccgtagaatgtgtagagagtgattcttaatctttgggctacaatgtcggcctgatgttgtgtgacagggcaagacccgttttggaaaacaaggtcgcctgtatctgagtctagtagcaagtccatgatagtccttatgctgtagcgatgccagatgtaccattgcccgcagtaacaccaaggtgtttgtgggttgcaaatggaatgccgttgaatgtggatgtaccactctgtgtgtagttaccagtgtgagcgatgttgccagcccaagtggtgaccgctgcattgatgttcagttgtggcgtattgattgtgtaagactcagtagcgttgaccacacctgtcttgcagttgacagttacagcttgttctgtgttgacgatcatgtcaccagactgcttcagtatgatattcacttccgtgccagaggcaatgttgtgtgcaatacacaagtcactgttcgatgagtgagggaacttacgaatctgtggcctgttcaagctcttaccgaatgggaacaagccgggaatagctacagcgtcttggtcagagaatttacgatagtcattggctgttgtaggctcaccagaaccaatcttgaagttgtccatagaacgctgggagaagatacagaacactgtgtcaccagcattgatagggaagctaatcagtgtggcttggctccccggaaagatgattggcacaccaaggatttgcatacccggttcgccagttccatctttaagcaggttgttcacagacgggataacgtcaaccttctgagtctggttgtcttgatagacattgacaatcttacacggcatggctgtgtagacgtcagacatatcaatcttgaattgtgtacgaataatatccatcaggtctgaagcaatcatgccaaatcctccgctagaacttctgaacagaagcattcaacataccactcacttccgcgatagtcgccagagaagcgagcagtgttaacacggtagaagccagtgatccatttggattcaagcttgacgatcttgccgggaacaatgtctgtgttcagtagagctttaaattgtacgcctcgacggcgcttcttagacttcttgggtttgcgtccaacctctgaggtgtggaacggcatgtcaattagtcctgtgtgttcgttcaacactggtgcaagcactgtgtccttgcttagaagaccgttctcttcagagacgttcagtacgccagagttgatgttgtattccaagttgtgggcctcacagagcttcataagcatctcacgagggctgcccttcaaacgccatccaaataggattgggttgttgaggttggttcctgtataggcaccacgagcaacacccggcatctgagcacgaatctcttccagcacgtcaccaactgtcttgcccggactaaccatcttagccagttgctggtgattgaggtccgtatagccttcacccatctttagctgggttacatagtcattaccactcttgactgtagaagtctctgtcacgtttccgatggccagaatgtgggcaccagactctttgtaaccaacagagaattccacttcaaggtattcactttcaaggagcttgatttgggagtcggataggttgtaaatctcgatgactgctgagttgccgttgttacgtttgttgtctgccgatttggaaacatcaaacgtaatctgccaagggttatcaaactgttgtctgttaccattgatacgtgggttttcaatcagcaaaccatttcctgttttatagtctccgattttcagggagaacactctatccttctgtgccatagcgttagcttactccgtgttatagacgtaaaagagtttgaagaactctggcatgatgctagactcttcagtgattttgtttgagattgtagcgttgactgggagcaacaagaagtagccggttaggccgtagtcttctaagttgtagtcaacgcacatcgggtattgcggaaccagagcataacccaaaaggattggcgtctggtcttccattctaacatccatatgccattgagagcatcttgtgttccaatagaaagtgaactgccaagactgaccttgtagggccagcccgtagcggtacttcaaatcagagtacagaggcatctcgacataaactgtacttaccatgattagtcctctttaagacgcagcggcgctcgcattcattttggtgtatgccttcggtgtgttctctggtggagcttcagcgtccttacccttcttggttgttgttgtcccagacttacgacctttgttggacgtcttgaccttaaccgtaatctcttgcaagtcggtaaagacaacctgttcaatagtcattgatgggaacacaccatcaccagtgttagcgtcttctctgaatgtgatgttagtaaagatgcatggactgaattgctcaatcactgtattatctacaatgtccaacacctgaaactcttccttggttctccacatatcaatcaagttgagctttacagccatggctgtcttggctttctcttgagcggttacaagggcctcagggattgtgtctctggtgaactgtgcgataacctcaggaagaatcctgttgatggttgttcgctcgtagatttccaccggataggcagtcatgctgttgtttgtgtattgcttattcttggagacggcagttccgtcagcagccctaacttcaatcaattgtcgagtgatgttaaagtctgcgtcagagaagatgccgctgatgttgatgatcacgttgtctgttgtggtgtgatcagagacatacccaccgctagcgatgggatgtttcgtgacagacgcagagtacgttgtagtgtactctgtgatagcatcaaaccagataatgtctccgttcgatcttcgaagtacgatagccattattgcctctctgcttgttgtgctctagcttgaccaaacgcatcacgtacagcagcttttgtaagctcttggatgtgtgggccaaatttatcagcgaattgtttcgggtcagtaccctctggagcagggaccgaaacttgtagggtgatagcacccggagcgattgtaattggagaagcgcctctatcaaccgcaccgctaccagctagaccttggcttgtaatcggcatagacgagcttgaggttaaatgctgagccagactcttacgttgacttgccggggcagccaaccaatctcccagcccactccagaatccgggaccactgtcagcactaccaccactgccagatgcctcactaccaccgccttgaccccaaccaaagtagtctttggcacggttatatgtcgtgcgtccacctgttaggttgattccagacgcagcagcatcagcagcattgccgtctccattagtaagagcttcaatcaacttcatcgtgttaaggatgttggtaagtaccacgtcaagtgtcttcagtgttgtcagcagcatgtcgttgaatgtcagtcctttcaaaccttcaccaactggagccagcttctgaagaaacttgtctagcatatcaacaataccagtgaaggattgcttgatattgtctacagcttgttgagcacccggtgtgtctttaaccagttcaccgaatacagacttgccaccacttgcgtaagttagcaggtcatccagtgcaagagcagcagcaccaagggctacaatgaatccaccgaacggcagcatgaagattgcaataccagcggccaaagtcgccagtgcattcttgctcatgcccatcttatcagcaatcattccccagttttcaccaaggtgaccaatgatacgaatcaaagcgtttacaggtttaaccagctgttcaaatgcagcaccaagagcttcagtcaatgggtgtgctctgttcatgctgtcagcaagcgtattgaagaagctacccattcctttgtcgaaaccacctttggcgaagaccattacagactcttcaaaggcaacgttcatacgaccttgagcaacacgggttgtttccaaagacttctgataagcttggttatcttcagaagcctttttcatcaatctgcccaactcaggaagaatcttcttagggtcggccttaccagactgcatcagttcactgaattcagcaaccgtaccgttcttggtttgtccagagttaccagcagctttagcaagcatcgccataccgttaggcatacgttctgcgaactgttgtctggcttcttcagcctgaatcttgtccttaccaaacatttggctaagagcggtcaaagaacctttcatagcctctttgctgataccatgcgttgtaccaaactgcatgataccttggaacatatcttgtgtgcctttcacaccaatagatggtgaagcggcctgatagatacttgagaactgtggtgcaatgtcacggtagttcagacccatttctctagaaacgttggtcaggaagttcttgttggagttgaagttctgctcattacctgagacggcctccaagctgtttgtagcagccgtaaccttctggttaatgtcgttcatctgcccaagggcgtacgcagctcctaggcccggtaaagcgcctctggcgaagcctgccatggcactcaagccacgatcagcaccaccataaccaccgcctccaccaccatttctacgtctacgaatatcttcgtcacgagcattgatacggatacggaattcactgcctgcaagtgccgctctgatttcatcaatcaggtgttgcttgtccactttcaatctaacttgaggatcagccacacgaatcttcaatgcaccaatctgagtctgtgcatgtctcaacgcacgacgcagtttagtgatgaattgagttgcgttgaggtgagcttcaacagtaatcttctgacgcttaccaacggcattaagctcagaacgcagttcacgctcaagctttgtaaggtcaacgcttgcaggaatcttgatagccatctggcccatcattgttctgatgagacgtttctggtctacaagcttgctgatatcaaccctgatgttgtcaagtctgatggttgttttattcagataatcctgaatacgcttaccctgatgggcaagcgcttcttgggaaatatcaacgtttgtgaggctgatctttgtcttagttgctcgctcaatctgagcacgtagcgacctgctatcaagagcaaccttcactgtaaatttcttattggcgagcgttgacaactctctcagcatcacgaggacgccgccgagtctcttctcaaacgctaccagtggtcgggcttcaacgttgaacttcaacgtacccgtcaggcgagcaatttcctcttgtagcatatagcctcactgttatttattctgagcggcctgttgtgcttgttggatacgtgcaacttcatccatctcaaactttgcatcaagcatctctaggatgttgtaaatgtcctctacgttgcagacggtatccagctcaatgtaactgggtagtcctctgatttcgcttgtcacgatcctgaagatttcccagtcttggctgtagccttcctcaaccttcttgagccgaggatgcaccatctgtggttccgcgttagatgttacaggacgccggaacctagcatctgaaaaaccgatccgtagttaaactccacaatctctttgaccagcatgaacagcttgtcgtactcaccagcaaactcgctgttgaagttgattgccatattgcctttggaagcagaggtaaccagagcgatgatcaaggcttcagcgttgtcatctagattgtcgaacaggatgttcagggctttggcaacactggcttcttcaccttgcaacactgcaaaggatgggccaagggtcttaatcagttgcttgcccagcttcaggccagtcatacccggcagttgagtcagcaggtattgttcgccgttgatcattacttctttctgttttatcgccatgttatctttctcctatttgtttacaattattaaagtgccactgacccattgccggggcacctccagttttaccacaatgaggacactcaacaacagcatgcttcctgttggaccgtgtgatgctcattcttagctttgtttcttctgaatgctttaaacctaagtgacctctggcagtggctgccttgtgttcatcagagagcttagtaccgagcttaccagatgatatcgcagctctgtgttgctggctcttgggtttacgcattctgtctttagactcttcagtggttaggcagccgtcacggcctctgcctcccaaggccagattgtacgtgtcttccctcatgacaaagtattcgtcaacgattagagactctagcgtgtaagcatcttcactgtcgtcgcagactgctaagatttcacgagtgaagatatctctgccatgcaaggctatggcacgcttcaataacttgccagacccaaggtacttatcgtccagtgtgcctttatgaacacctacgtagaactggcccgtcagtgtattaattgttttgtagacgaaccatatcttcataggcgctccttaactaaagtaaccagagattgcgtcaaggccgttgttcacaagaccttcagcacttgacctcgctccagagagaatgtccgtaatgtcaataccgttagaggcgttaccaccaatgttgccggatgcagttacgaacgatagaatttcgatttcccatttgcgtgtgataatgccgtcagcattgaacgctaggtctgggaaggtgtgtaggtaggcattcgtagaagagaacctagatgtaccactggtgtctttcaaatgcacttcaagcaaccctgcatggtttgcagcgtcttgcaggacaatgcttgtgaagacgtcattggctaccgaagtaggcagcagctcaaggcagagtgttgcttgcctgtcagagttgtagacgcgagtgtgtacgcctcgaatgcctttgtgcaggctgaagacctcagacttccattgaaggttgatgctgacgatccccggaatgatgtacccgcaaacaataatggtaacactgcttggatcataagtcaatacagaaccagacataaatactccttaaatgatttggaaagcttcgagaacaggcagtgcagcagaacccaaaccaaggatagaactcagtccgccaaagtcgttaccaccaatgttgattgttgcgtctgtagctgcgaaacgccatgtacgggtttccatttggctggagaaaactacgtcaggcagttcttcgatccaagctgttgcagccataaacattgtgctaccgctgccatcgttgatgagcatagggaatttacccattccggtaaccttgtctacgttccagagcacagagaaaatgtcgtttgctggagaggattgagcaagtgtgatttcaactttccagccagtgtctggcgacttcacgcgggacattgtaccgtccattgcacgtgtagttgtaatttgttgtgtgtctttagagatgcgaacgaaagtaccctcagcatagcctgtaactgaatacaaaccagcgatggtaatcgttacatcattcggggcgtagtttagtaggcttgccatttagtacctccagataaaaagaaaggggccgccacgaatggaagcccctaacgaatgtattacgattgaatccatttcgcagcgatagtaccaccgagagtttcgatagtagcttgatcttctggagtcaggattgcgttaccaccagcgtaaccatcaaggttgaacgcttggatcacccagtcacgtgtcatcatgctgttagcaaaaccagcgttaggacgcacgccaatgtaagcatcatcagagaagtaaacagaacggcctgaagagtctttcacttggacagagaatagaccatcagagttacgaccgtcgttgttgaacaactgagagagtacatcgttggatgcagatgtttgttgcaggctgagtgtcaatgtcgcagagttacttgcgttgaagacacgtgtacctgtgttgtcggcaccagtgtacagagagtagcgtgggcttgtccattcgatgtttacgatggagtcctcagagtacccgctgatcaggtgagcgatgcctgtgctcgattgtgtaataatgacacttacatcattcggtgcaaatgtggcaagacgttgtgtagccatttgtcagtctcctagtagaggaagtaaccgtaattaaacggttacagttcctgcgattttaacgaagtggatagcaccggcaaggcgtgcttcgaacttgatgccttcgaagatacgttgagcacgggtgttagtagacaggctaagaacatctggaacttctacagttggtgctgggctttgagccagaccaccgacacgtacaccatcgttcaactgagcacgaatctcagcttcgataatagcggcacctgcggctgtgtaagggattttcttgctgttcgccatacggctccacagacgttccttcatgcgctgttctagccagtcaacgaagatgattacgtcgatccactcaccaccgaacatcttagctccgatagtcgagttcaggccaccaacactttcgtatgtagaggctgacttgttgtggatgtttgtggactctgtatcgctcagagaactaacgctaacaccagacagagctttgtaggcccaagtgttagaacccggttgttcttgcagctggtaaccaacccaagcggcttctgggaactgagcatctgctgtggcagagtacataccaaaggtacgttggtaaccaagggcttccagtttcgagaatgtatctgttgagtctgctgtcttgatatcggcagactgagaagaagttgcgaaaactttcttcattccttcgatttgaccggctactgccaatacatcggcttcagcgtgggattcaatcatcagagcataccaagagttgttcactttggtgatttcattgattgaagttacccaagattcaaacgaaggttggttggcttggttcatgttagggcttacttcaagcgagtaaccaacagaagaagagatagtcagagaaccgtcaaggttgtcagtgacagccacgtcgtcgataggagttacatcgtaagctgctttcaggccgctggcgacttggatagctgtacttgaaccagttgcaacgaatccaaaaggaaggtcgttgattgtcagtgtgtatgttccagcagcaacttggtttacgttgacagtagagcttggaaccagacgacgaccaattacgatctgagatggtttcagtgtctggccgaacaaacgttgagcggcaacgtaggcactgtctgttgggctaaagtcattagcaacggcagtgaggctggaatacgagcgtgctctttccgcaaacttggtgtgggcagagatgaacagaggcacgttgaagtttgtttgagcaacggcagcagtttctctgctgatgttgatttcaatgatatccgtaagaacggtcatacgttattctcctaggtaggtagagttatttcgaattgagtcgtgattgtatagtcaggaggctggttcgcatcatggtagatgcagtcgcctttaagaccagcagcgtattcttgctctgttgtgatcgaagatgtatatgcaaaggtgcagtccaactgatagatcatgtacacgtcagtgtctctcggaagaggcagcctgcgaagtgttgagagcttgaacagcgacagcctgttggcagcctgtagttcataccctgctggtgatctaagctcaatctggagcagctgggccatctcagctacagaagtttggtcatcgtatttaccgatgaactcaaatcgaacagttgcttcgtggtcttgcgttgttgtttggagaagcttgattccgtcaccaccacgagttggggtggaagtgtactcgcggccaatcgggttcaatctcttcacatcaataatgaggtaaggattgaccggctcagcagcgttagtaaacgcaaacaggatattccaatcaggatgcaaggtgctcacaatgttgtacagcgagtcttcgaggtcttgatagatattcattaggtaagctccactctcatgcacaaggctttgtagtggttaagcacacccatatcgtaatcaataaccttcatgacttcgtatagctcacctttccagtagaaacgatcagcttggtagccattgactccttcttttctttgcctcaacatatcaccacgagtatacactttgagcgttgcacgtgtgcgatcagcttcaggaagcaaataggtgtctgtggatttcagcaccggctgtacgttgcatacaacctgtacgatactctcagctccggggctaggacgcccacggataattgtttcagcctcacggcggataacatcgagagtcgtgtgtccagttaggagcagtggtggatttctcatgttttactccttaacggtgaatgtggaatctaacagactcaatcatcttgcctgtgtcgataagaggcgtatctctaccacctttacgtctgatagtctcaacagagttaccgcccatggcagcatactgttggatactgatttgcatcagttcgccagagagacgaccaagtgagttcaacaacctttgtgtggctgttccgcctttcaagacaccttcgaatacactcttcatgcccttagccatgtagaattggttcatgctttcggagaatgtgtcgtacatgaaaggtctttgtgggttatgcacagtaccgaattcgttgtatgcagctacagtagctacaggcaagttgtggttctcaggaccgtatctgtcctcttcaaagaaaccaacttcgacttccataccatttaatttgtccagcctcttcatcagggctggtattttgttgtcaaacttaatactgaatcccatgtccaccacctgcaccatgacacatcagatcatagttgtgctgccagttgccacaaccaagttggaagtgaccacgttcagtggaaagcatgactgagttgttgtctatgttcatgcggttagcatgcatgtcttctcgactgataccaccagcataaggcatagccagactcacagcaatgttcgggtctttcagaatcagttgcaaagctttgaagtagttgctgaaaatgtcaccaccatatacttcgatatcgcctgtacgttcacgtgtgaagcgtgacaaggcaaacagcaaagctcttgcggcgtctagtgttgcacgattttcgctaccgttgttcttatcaataaaatactgatagtcatcatcgtgaagcaactccatatcagcccaaatatcacctacgttcaaacggatacgatcagtggcacttgtagatggtgatccagtgtaaggcatgttctaggctcctaagcaaagaaaggggcaggcgaaacgcccgccccatttcaattaagcgccaacgacgcctttaacgatcaactgtggacggcgaagcacgttcaggaagttggattcggtttggatttcgatcatctgaccacggttgtctccgtattcgaaagcgtacagctcttggccttcggtgttaacgaagtcaaagtggtcggctggtccgaagtattgtacgaagttgtagccgtcacctacgtccgatgggaagaagtaaacttcgcccgctggaatctggcgagaaccgtctgggttgataccacggttttcgatgtaagtgatgttaccgatggtgaattcacggtaacgggcatcgtagccacgcgcttgcagacggtcacgaaggatttgtggagactgttggtaagccagccacagagctttcatggttgggtgactgatcagcttagcgaagaactcaggcgatgcaacagcccaaacttcaccacggacagtaccgtcgagagcgttgtcctgaacagccgagaagacttgttcagtcttggcaatcaggtcagttgtagcggtgttaagttcgaagtcgatttcaacacgggttgcaccgaactgggcgtaccagtcgtaagtgacgttaccgtttggagcgtaggcagtaccagttgtgatggtgtgccagatagctgcttcgtgtgttgcagcccagctcttacggatcacttcaagcttacgagcacgaacagcggcgatggtttccagctggtcaacaccgaaagcacgcttaccttggatatcacgtggagtgatcgaagcgtctagggtgaagtgtggaaccgcgaaggcgtgcatgcggcgagtcggatcactgatcacttggtgacgagcaccacggtgaacgtctttgatcagaccgtagccagttgtgatttcttcgaaagtgattgtctcttgcgaagttgtgtctttaccgaagattcccagctgagttccaaggaaccagttgttagggatgatcatcagtggagcagacaggtcggtgtattcgaagttgttaccggcgtaactacgaacggcctgcttagccaattgtacttgattagacatttagtcctcctgattagatgttgttgtaggtaatctggtcaacagcaaagatgttctttgttgccagtttgtcaaaaacagtttgcttctgtgcgtcacttgtaacgtcagaaccaaagatcagtgcagctttacctactttcgcgtgaccgcgagccaacaccaatacgcgagagtattcagcagcggcaggacgggtcaggtcgtcaataagaatgtaagtagcgtcggccaaggttgcagctactaccagcttaccagtgctgtcaaggacagacccagtgatagttgcgttaacagcagacttctgcaatacttcgcgagtaacgcccgaagctggttcttcttcgtagaccaaccagttgcttagacgttgtacatcaccagcgtatgttgccattttgtaaatctcctatagggtaaattacttaacgccgtaacgggctttaaggattgcggtagtgcggtcaacttcttctgccgtttctgcaccagcaccgcttacgcctgcttcttgcatcatgtcagagttatcaacagcagaggccatagacttcagcagctcaacctgagtaccaaacgcttcgtcgtccaaagcagaaagagatttcagaacagcttcaagtttttcggcaggtacttttgcatcagcaagtgcagacttgcgagcttcaactttagcagtggcagcagcagtttcgtattcagccagtttgtcttgagcggctttcagcagttctactttagcgtcaagggctttttgaatttcggtaacagcggcaacactagcggctttttcgattgctacagcgtcagccagagcttcgatgtgtgcagacttcaggatagtttccaattgagtgtcctcatgtttgattttggtttgttctggcagagactccagagctttttccagcatctcttgatctttcaagacagccagtgattgttctggagttaggtcagcaagtgccttctccaagtttggagcacggtagatcgatttcatgatgttgatagattcaactcttgagtcaatccaatccttttcatttgagtcagggtactctgtacgcccatacccaagtacagaagaaagaacttctgaatcttcccagtacagtccaaagaacttacgaaggaattcggggaattgcatctcgacggttactgttgtagccttttcgatcagctcttgttcgattgtattggtggctttggtgataagggttgtcacaccattagcagggccaccttggtgcttaccaacaagggctacgtgagcaccttcatgttggaagctgatatcagttagacgacgttttgcaatagtcattcaagttcctctgcggttgccatagcaccaatggagacaccattaatgtcaccagccttaacaccttgccacagcgcctcaccagtttctgtttcagggaactgccaccattgcagccaagtacctttctgaacttcaacaccattgtctagtgtgaacgtagcaggagagataaacgactgtacaactttggcttcttctgtcacaacttggtggaagaggtttgcaacacggcagtgttcattgtagttgtcacaagctttctctacttcagcagctgtgtatgtatcaccatgaaggtctacaacatcaggctcaaggacaacgaacagggccttacggtcttcttcgtctagggacttggtaacttctacctttagttcaggagactcttgcgagcctccgaagtgtttctcaatcagctcgataagagcctttttggtaaattccatatgtcaactcctatgcgttgttagcagcagcattgtctctggacgaagcattcgagctagcaccattaccaccacctgctgccattccgtcacctgcttggctttcgcctcccatgatttcttctttgtcaactggttcgtcgtctttcttaggtgttaccttgattgattcacgaatcttgttcgccataggacggtcaagttcaagagcaccaacactacccatacgttgaattgctttagagaattcatccaagtcaacttcgtcaagatcaccatatttcaacttaggaagttccttagctgtcagcatctcaccgttaagtgcgaatagctgagggatcaaatcgttgttgagcacgtcttgaatctctttcaggcgggcttcaatagccatcgccataatgtttgttttggcaccagcaagtgagtatgatccaacttgatcctgtcccatcttcaacatgtcagcaaacaacaccatcaggattttgttgtcccaacgtttgatgattgtgtcagtgtcgtacatctttccaccttgagtggaagtcagttcaaacttgaagagtggttgacggctctctgggtcaaatgcttgtggcaagatcaaaccagattgctcgttcatttggatgttgcggataacgttcttgtagtattcgaagattgccttctcactatcagatgcgtcttcactcatgtagcgtggtggaaggtacaaggttggcataccgttcatatcacgggtaataccaatggcttcttgttcctcaatctgtctgcggaagagccaagcgttgtagcaaccacgtagagggctgttgccttctgggttgtcacgctttgagtctacacggaacagcataaatttcttacgtggaatctggatgacgccgttgtcactcaggttgatataacgatcaccattctgtacgcccgccagagactgctcaaggccgactagctcacgaccgtcatcactgaacacccaacgagagattgtgtcctgtgagcgaactgggagcttcttgatgccaatcttgttgtcattgtaagaagaccctgcttcgtatgtgcgacgacggtaaaccttttcgttaacacagaagccgtaagtgtacatgctggttacttcacggatgaagtcatcaaagctgtgatccatatcatgaatgacagactcaaggaattctccacgagccttcatggctgcatcaggttcaacacccagatcaacactccaatcaacacgactaatcatcatctctacaagagagatagcagacttgatcgtagcgtcttgggacattgttctgaatgttttgcaagcttcagggaatcgaagctcacgtctgttttcttctacaacagcaccattgtgctgcttgagtcctacactaccaatttcaccaagtcttagacggggcattggagcagcgactttttcaatcttggttcttttagccatgagtcctcgccttatctatagaatgcaaatgggttggcctgtgtcattgatggaactgagaagtcaggaagatactgttcagaagacaatgcatggaatgcatcggacgtggcgtccacttggtcatccttaatgttcttgctaccgtcgaaacgttcaagttccagcaagtagtccttcgtccaatcagcctcaacaatctcaacactcccggcttcagctgttgcagcaaatggggcgaatcgagtgactttggatttgtttgtttgcttcatgcgagcgtagaagccatggtctgccaagtctctaatcaactgtgcagcataagctttaccggcagcaccggggtcgcatggaataatgatttgcacatcatcaccatcgtgtcttgcagtttcaaggataaggtcgaatacaccaccatgacggcgacgatcacgaaccacatcttctactgtgtaagttcccatcttgttgcggctcatcaagacaccagcagtccagtcagggttacgattagtttcagatggaacggagccactgatatcccatgcacgaacacgcttaatagaagcaatgtcacgctggcttaccatgttgcaccattgagatttgaagtagcctgtgccttcagcacgtgctagccagcttccatacagtagacgttctttctcaacgcggccaagaccttctagccaaccaacatattcaggttgagcattacaaaggacggggttgtcgtagacgttagctgcaatgaatttgaagctgagaggtttaacttggttttgatgatcagcagatagatgcggcttaccatacttctcaatcaactctgtcctactatcgccccaaaccatcttaccgtcctgcttcaagaagtaacgggtcatgccgtctctctctggaataggaataccagtatctggatcaagccaccattccaaccaatgacgcaagaagctgccatagtcagggttacaggtgatcttcatgtggggtttaacttcagggcactttgggttacgcatacgagatgtgaggtattcaaccatcatctcttcgaactgttggccttcgtcaacaaggaagtggtttacttcccaaccttggaagttctcagtgtctttagggttttcaaagtgacggaggtaaatcttagctccgttagagaagaggaagtggtgttctttgtcacgccatcttacctttggatcaagtagtttgaatagctcttcggctttctcttggagtccgcccggacctttcaactgcggagttgtacgtcttaccatacaaccacggaaatttgggtactggatgtgtttaaggaagtccataacacccagataacttttaccagctccagctgctccaccgaatacggtaatgtcagcttcactgtgcataaagtcatattgctttttcgactttggcccgatgacgttagggtccaaatcgaagaccatatcgtcagccattgcctgtcctcttattggaattagaaaagggcgtggccgaagccacatccctgttttcgaactagagaattgctctctatgtatgttattgtacaatggaattgctggttgtcaacccctaagcataacatttatgtaaaatacttgtcaagcgggaattgcagctagttgactaaccttgatagtccctgtcattgggatgttctggctgccatataccgccacacgaatctttacttctgtcgcagttgctgtaattgtagctggtggagtttcttgcacaccatccactttcacactagacattgggaagccttcttggtaacggtcacagcacttcacgaagaacgtggtgccatcagcaacacgcatatcaagcgacacacccaagcaaccagtcatttcaaactcgatgttagcaacacctttcagcgagccagctgctttagcgtcgtcgagaacgagtgtctgttcaaaggtgtacaaagagccagtggccgttggagtaccagagaatgtgaacacttgtttctcaccaactgtaccaacctctttggaagccacaactttcataccagcccaagagctgccagaaacagtgtatccggttgctacgtcacctactgtgttggaagacccagacttagagcctgtggtgcccgtcaggagggcgttggtgttgagttgaccaaacgggttggttgccttaacgaaagggctggagaagcgcggtagagccgctggagaggtgaacaggtctttaatctctttggcaacagcctcaccaacgatgcgggcaccaactgggttccagtgtaggccatcgat

SEQ ID NO: 20 - DNA, 42630 bp, unidentified
  misc_feature 1..11: note = bacteriophages nucleic acid sequence
  source 1..42630: mol_type = genomic DNA
caacgatggcggcagtgtcgggacgacgctgggcgatgttgtaggactggaaggtgtccagtacccacgagaactcgcgcttgtcttcccagaagtcggccatcagcgggtgcacctggagcacgatcagggtcttcgacgggatgagggtaatcatccggcgacgagcctcggcagcgctcacggtgaatgccgagcccagcgggtgggtggcaatcgctgcggtcggtacacgcggggtctcgacgatgcgcacgccgttcagcatggcgatacgcgagcgagcgaagtcgttcacgccacccagtgcctggaactcgacgttcatcagtttcttgtgttccagcaggatggtgaagatacctgggtccacataggtgatcgcctcgctgtatacagcgtcagacaggtcacggttgatgagcgcttcgagcgacttgcggtgtgcggccaccagcagcgaggcgtcagcctcggcagcggctaccgtgccagcgatgctgaccggtaccaggatacctgggttgaacgagccttcgaggccagcggggaccacgaagtcggcgcacttggcggcctggatcaggcatgcctggtcgagcagcttggccatggcgataccatccagctcggcgatttccttacggtagtcgagcgaggtggtccagtcgtcgaacttgtcgaactcgtggcgcaggtacaggacggtatcgaccacagcagtgaacttgtcgttcacgactttggactgcaccagggcttcgcccgacttacggccacctacggccacatcgccgaagcggtcgatacgcgcttggttggtaccacggagggtacggatgttcatcacgttcgccagctgggagctgtaggcgaacaccttgtccacgatacccaggtgctcctcgatgtggatatccacgtcagcatctggaccaccccattgcggacgggtcagcgaggtaagtgcagtcattcaaatctccttgtgagaaggccatagcatagcgtcggactagccgggccagtggctatggcgcgattctgtgtgttactggggtatgtgacagttacaacccttgctgcatacccagctggcggaggcggcgcaggttctggtattcagcactaccctcctgtacgccacgcttggtgatggcctctgcgaactcggcacggctcaggccgcgctcgctgcttgcctggcccagcggtggcgcgttgtggcgggtcacgacgccagcttgcacaccgtactcagcgatcttcttggccgcgtagagcatcttatcgcggaccccactgtcgagcagttcggccagcatggcacgctcggttgggtcggccttggtgttgaacgcctgcaccgccaggttccactgggcctcgccaccagctgcctggtgcacctggctgaccgactccttctggtagttcgcggcgtattccagggtgctggtagcgagcttaatgacctgatcagccttgtcgcccaacttctccttgaggtagtgcacgtcgatacgggacgggtccaggtagtccgctgcggcaccgagcgcacgggtgatgtctacctgggcatcgttcagtacggcctccatgtaggctacagcgggcgctacctggctatccgccgccaggtggcccgccagctcagctaccgagccagttggggctggcttctgaggctcctggggctgggccggttgctgctgttgtgggacctgcacatcggctgctggattggccggtgccttgttggggtcgccttctgcgaacgctgccaggcccatcggattgaccggggccggttgtgcggcgggggtctgggctggttgggcagcagtttgcggcgctggttcttggtccagcggggttacggtcgccggtgccgtcggcagtggttgcggggccggttgggccggagtttgcgctggtgcctgagcagctgctgcgatacggccctgcaggccagctggaaggttttgtacgttaccggtcattaatcaccccaattgagatacggtttgttggatcgccggggcttgccccagcacgttcgtgtcggcctgcatctggctcgcggcctgagccttgagccgggcctcctcggccatctgcgtggcggtcttgaagatggcggacgtgtcgatgttcttggcgctgtacagctggtccaggagtttgtaccggtccacccggtcatcgagctgcatgatagcaggtacgacaatcgcggcggtttggctgaactccagtaggttctgtacgaacaccgcttgtgtcagcgcgggaataccggtcaggatctgcggcttgtaggctcgggttaccagacctgccattactgagtcagacacctcagcagtcaccaggtacgccagtggcatctggagctgttcggccagcagggagtacaccccaccgagcatctgctcagcctcgttggctgtcatccgaatttcttcggcggtcactcgctcagcatctcgggtattgcccgaatacaggaacgccatgcttagccgttgcacgatctgctgcaactcgccgctgaccgcagcgatcttgttgtagtcgccgcgctcgtaggatttgacaccctcgaccttgccgcgaacgaaatcaccggtatccgcttcctggtactcgtcgatcacgccaccggctgcctcgtcaacgaggttgagcagggatagtgcttcgagttcgtacaggcccagctgctcggaaagcagactcagcttcgcgaagtccccggtgtagtcctccaccatgcccctgccgtagtgctcgccgggggacaagttccaggtcgccagaatccacgggcataagtgctcggggtaggacgactcgggaccaacgcggataccatcgatctcggtggtaaccacgatgcgcggattcacgataccgacctggcgttccagcttggtgtacagatccacctgggagtgcagccggtctttctgccctggcttcttggccaggtagtcattgcggatggactcgggtaactcgtccagctggaactgctccttgaggacaacacaacgccactcgccgttactgattcgacgcaccgcatagctgtgcagcgtccagtagcggatcgccgccgtgtccttgtcccggtacatcagcatgttgccggtctgtgccaacagtttgacgatgttggtcagttgcgctgtgctggaattcaggaatagacgctcggcggccttgttgtccacctggttgagcttgttctcaagttccgcctcggacgtaccgttacgctccgccgtggccttgagatcctcgctggccacgttcttgaagaacgggatacccggcgggaacagcgctcgggttaccttggcccccaggtggttcagcaagaatccaccgacagactggaagtcatgctgcacggatttctgctgaaccagcggatctacgaacaggcccggtagtgtgtactgcgcatactgctcacacttccgaatcacagcggtgtcgcggtacttggtccaaagcgctgccgctgtaggtttgctcatacccgcactcccagcgaggaggcaacgccgcctgcggcaccgctacggcggcgacgggtgttcgccatggttgcagccgtaccaccgacctcggtatccacaacgttatccaggccgaggtcgatgttggcgttacgcgccgcagcggcctgagctgcgagtgcagcctccgtacccgacatatcgacgttggctggcttcggtaccagtgggttggttatagggccttccccaaccgtcccgagggagaagatgttagtgacacctttggtaccgcccaaccatccgcccttgctaccgtcaatcgcgccgagcgtggcaaccttgcctgcgctcttaacgaccttcttcactttcttgcccatatcacttctccagacgtatgtatttcacctggtagatgccaggcgctgtccggtgcgtgtagcacagcacggcgaatccatattgccgtgctcgttgcatggcggctcgcagcatacgctgtcctacagtaccgcccctatgtgacggcacaacgtagtcccacattaccgtgaggcaccttcctacgtgaatgtcgtagtcctctgcgagtgcagagaagccaacgatgcggtctttgtcgaacaccgcaagttcgatacgatcctgttcaacagcgctagccagcatacgctggcctgctcgctccttgtcctcttgccaggttagttcctctacctctgctaggacctctgggagtatccattcccccatacagggatcacctctcctacggatacgctcacataacatctcgtggcctcataggtactacactgccgatgttctcctccatccatttcaggagagcggctacacctgcattgtagaatatctcatcatgcggcataccaggtactacaggcttcttggagttaccccatacctggtgtgctcgttccacttgggcacgagagaacttaacctcttgcttctccgcttctctcatcgcttctctctgggttatgtgacgtattgaattctccctcagcagaagaagaattcgctatcgcgcacagtgtttagatcaagcgttccggtactggggtatgtgacgtttaccgccagctggttcgccagatccgccaggaagtcccgttggtacatggcgatgaacgcctctcggatgtcgctatgcatggcatccacatcacaagggtgggtaccgaaggagtcatgaatgcacaccatagagcgcccaccggcctgcatgcgcaacgctgtcataccgaggtgcgtaccgtccaggctatgcacgaagttcgggctgatggcattctgcatgcgttgcggcttaaccttgtccagcttgcggtacatcacgacgtactccatgtcgcatgaccgcacccgaacacgggtccgctcctcgtcccggtagtcgtggaccacagggaagcccagagcggtgcagaacgtcaccggttggtcctggggcaccttgcgcatcaaatcgcgcaggaaacgcatggcagcagctgctgcgggtacagtctcctcgacggcgcggaacatcagcttggctaggtagaagcccagcttgtgcagcgcgatatcggggtccttgtagccgatctcgtccaggtagtccacaacacctgccgccactgtgctcaatgtagcaccgtagacatacgtcataacgggcttcttggccaggtttcgcgtgatctcgatgttcgcccagcgctgccccaaggggcatcctgaacgtgcgtctgcgtccaccatacgcttgacgagcgtcgccacctgccggtagatgtcggccttctcctcgccaccggcgaccaggttggtgaatgcgccgccaactggatcgcgcagtattgcgctaaagtgctgcaacccggagcaggtcgcatccatgtggattggcagccccgacaggaacgtctcgggattgccgctggagatggccttgtgaagctccaggatggccgcatacgcgcatagcgggctatccgcctcctcgtatacgcccgatgcttccgggcactccagagagcctcgtaggcgctcccagtgctcgtcggtccaggctgcgcgctgggtgaacttctggcgatccacgccgaagcagttcgcgatgtgtaccttcaaccagaacacaccccgcttgcctagggcctttttgtctgcgaagtgcagcacagccttggcggagtcggtaccctgcgggttcgggctggcgcggtagtacaggcgcccacggctgtccaggaacaccgggtaatacaggcgctcaccgcgctgctcccggacgtgcttgacgaagtgatacatctcccacactacggactgatgcttccggcactcctcgtgccagcgtgtcgtgcggcgcttccactcgcggaacaccagcagatccgcctcggacgcctgcgccttgtcccagccctcgccaaaagggaactccggcttgggtggtggtgtagtgcgtggcatccccatggcgccgccaccggcaccccagatgcgctctaccagagcgtacacatccagatcgacctggaaggccattgactggaggtagttcacgtactggtagacctgggccatctgcgctggctggcatgcctcgtggaacgccttggtgtgctggcggcgtaccgtcttgcggtagttcaccagaggataccgcaactgcctccgctccgtgtaatacccaccaccggtcagtgcaagccaatccagcggcggcgcattcatcggggtgttcgtacccttggccatgatgatggctgcgcgcttgtcgccaaggaacgcctcaatggcctctgggaggcggtatacagcgatgtgcccctgtgatccggtggtacggtacacctcgaccaaaccagcttccaaacagccctgtaggccgtgcttgcccaggtgcagtagttcggtctcgtttagcgggttatcatagagaccatccaacgtgttgcgaatgacccgcgataccgtcatgctgatgtgcttacggctgctcacgttagcctcttccaggccgcgcatggccgcctggtagtaggctgggttgacctgctcggcctgccggatctggatctcctgaacccactcgcgagcgatcccgcaggcgatgcgttgcagcgtggcgccgaactgcgtgtccgatacccggatgtttccacccaggatcaggcgcagcgtggcgcggatcgcaatgaccgccgcgacatcggcggggatggcccgtagccaagtccgcaatgctgcatgcggcccacggctgcgagcctcctgctgggcgaccaggtagtcatggacatgcggaaagacgttgccgaggagcagcttggcctttggtaggcgatcgatgtcgccgctccgcagggcatcttgaagcgccttggcggcctccgcctcggcagtcacgtcggtgtttgtctcagcggcgatctgccgggcgatggcgtccacgggtgctccttatgcgtctgggaaggcttggtcgaagtcggcctggatgtcggcccggtgttgcacgctgatctttccgtcgtccaggtaggactcagccagggcgatgcaatgctctgcctgcccctggttgccagtatcgatgcaggctgccatctcgttgctcagggcgcggtaatactcgttgcgttgcttcattgcttctcctccgcgttgtgcagctcggccaggaacagggcgttcgtggcgacgtggtaccagtgactctcgcctgactcgtcgtccagcttctcgcccagttcgagcttgttcaggtggcgatacagcgcagcctggtagcgctccttggcgttcggtacctggcgccaggaatgttcggcatagcccttaccacccttgtccttgctacgcacggcgaagctcaggacgcgcaccacaccggccagtgccttggcacaaccctggcccgacatcaggaggaaccagttgggcttgccgtcgtcggctttgaatgcctgcgagctggggatgtccgctgcggtaggctgctctgcctgccaggtgtagtttttaaactcccagacacctccgcctaggtcccggccctgagatgcgagtgccgtatgtagcgagtgctcgcccatgtacaacatacccgtagcagggtccaaccaacgtggatcttttggagcctcctcacccaaccgagacgccgtatagtggcccttaattcgagagttggacattgcgttcctccttactgttcattgtgtaacgtcctcgactccagccaccacacgagatgcagtgcatgcgcgggtactcgccggactgggtgtaggtgacaccgcgcttctcgatgtgcaccgagccgcacttagggcaccgcagttgtggttcgtcgtctttgaaatagatcgccacgttgggatgaccaacgaaccatgggcgcatgacgagatacaactcctccatcgacagcacgtctgggatgttgtagtcgcgcatctcatcccaggcttccatgttgcccgccaggcactgagaccacagctcgaagcctgggaacttggcgtgcgtgttcttcttgtgccgcttgcacaacttgtctgtcatccactccagcttcttgctggtgaagccgaactgctgcttggcgatcaacatggtgtcgatcactttgtagggcgatggcggtagcttgcctgccaggacgaaccgggcgttgatcttgggcacgtcgaagcgcttgccgttctgcgtgatgacgatatccgcctcatccagcagattccacaggatgtctagcagcgggctatcgtccttgatatggtgacggcagtcgtggtagatcgggtcatcgccgtgcaaccacttcgcgcagaagctcaggatgcgccactcttccttgatctgattcagcccgacattctgcttccacagcgaccagacgtatgcctcgataggcgccgtctcgatgtcgatgctgaggatcttcggaccgcgatgctcggccaaggactgctgctccaccgcgtcagccaacttggacttgggcagcggggcgtaaggtccgcgtggtccggtgggtactgcctcgtcgatcagcttcaagtcacgcagccagtaccggcagctgttcgggatgactgtcccgcgccccaggtcggtgaggacctgggccgtaaactgcactcggactgtggttgtattggcagcccaggttgccgtgcgccacgcttgtctgatctcgtcgtcgctgaatagtgctcgtctgatgcgggccattatgcctccttcggtttcatggaacgcaccttgatgcgcgctttcttctgtgcggttgctgtacgccgtttgagcttggccgcttgggccttctcctcggcagtcttgtgtgtggggtacatccagccggtcccatcgcgtttcaggtaggccaggagattctccagccacgggatgatcttggcgtagtccatcccggtaccggcccaccggcccacactattggctaccttgccctcggcgccgttgcagccccggtgcagtacaccgcgtacctcgccggtgtggtggtcatggtcaaccacaccctcgcgggcgatggtcaggtcgatgggcttgccgcacagtgggcacagcccgccctgctgcttgagaaacatcgccgtcatagcgcggaggttgctgcgcgggatcttctttagttgccgaggcgacagcgcaccaggtagcgatgcagtttcttcaactgccgcagcttgaccggacggcacttccgtgtcccgtccagggcactcaggtagaagtccgccgcagctaagccgcgtggcgccattggggccttgcggaagaagctgggacgtgtggttcgcaggtcttcggtccgtaagggtgtctcggccatcaatgccttgcagaggtgccagtggtagtggttcattcatctttaccctcgtcctgctcgtccaaggcggcggcgagcactttctggtgataaccgtctagatcgtcaatccactggcgcagggccggatgaagatccagttcggtcaggtaggtatacgcagagtcagttgcgctgcgtcgcagccataggcactcggcttcggccagcgggttctgcttgttacgggcatacgcggcaagcacgaagttggccgcctccgattcatcgctgattggccgcagtacatcaagagtccccgcctcagcaatgagtttgccgtcgaagcggtcaagccctctaacgcggtcagcggaatctcccatgagcatttgcgcccagaagaacttggttccatgtccgatcaccttgagcttacccgcgtcggtatagctctccttgatgtagccgaagcgattgtcgatgtaatccaccaggcccgtagtgcgctcgaagtacggtgccgaggtcaggcgcatgtccttgtcctcgctcgacacgacacagttgtcgccgaatgccacaccgtccatgatgatgccgtcgtcagcctcccagaaggggtgcaggcgtacccagaactcctcgggcataccggggtcgccctgctcgaaagcacgcgccacagcctctcgtaggggctccagcagcgccggtttaggcttggacttgcggctgtcctggtacttccagaatgacgggtaaagcccccggtgggctttgaggcacccgcgctgcgtcaggtggatgcgggtgtgcgtgcagttcgccaggaactgctgttccaggaccagggtccagaagcgtcggatggcggtggggagcgtcttcaccgtagaggcggcccgatatgctgggccgtctccatccaggatgagggtgcgctgccccaccggggcctggaactgcggcggtagtgccgtcagatccagacctctccagtgtgtccgcacttacaggcccggaatgccagggatggccgccacgtccggtacggctggggtggcaatgctaccaccgtcgaatggcgggttgatcgcggctacggcgggatcaactgctgcagtcactacaggaacgctcagcgaggccgctacggctgctgccgctgcggggtcggcctggggtacctcgggcacgccaccggcgctggatgcgccgcttgccgcctctggagcggcatcctcgccatccgggtcctcgtcggtctcgaccatgcccatgtcaggcagcacaccgccattcaactccagcagcaggtgctccagtggcgagcctgggaagtccttggccttgaggcactgggcctgcaagaagttcttggactggcccttgtcattggtgccttcgatgaacattgcgtcccagtcttccttggtgggcatatcccacaggaaggcgaagtagtcatcgtccttgacatccgggatctggtagggctgtgcggtcatcggatcgagcggcggcaggatgcctgcccagtcgatcaggttgtacggcttgctgtcggccttgctgcccttcttgacctcgattggcagcaggaacgcctcacccagcatggtggcgaaggtcttgtgcttcttggtccagttcattttgtcgaagccgtgcttgatcttcgacttctcgttgttgcccaggctgatgtcgaacgtggtgaaggtgccgtgcgatttcacggtgccgtcctcgttgaccaggtggtagcagttgtcctggacgttctcgccaagcgggttggctttgccccacatagcgaaggtcaggcggacgacacgggcgggcgccttggccttgccctggaacacctggacgtggttaccgaattcgcggtagccgatcaggcgggcataggcacggccagcgggcagcaggcggcgaccagcgccacctttgctgacctgggacatgtcgaggcccttatcggctacggcggcggcttgttgttgcaggcgggcgagtacactcattgcggtttctccatgatagtgaccatttgagttgcgttcatgttgacgacgtgccgtgcaccggttggggtggtgaatatcagctggttcggatcctgctcgaaatccaccacatcctcccaacgcgaggacggttgatcgtctacactctcacgccagaagacgtgaatgatgaaacgttgtttgtgcttcatgcgacgatggcctccttcttggccatgctcggccccatctcagcggccgccgggaatgggacgtggctgatgttgtagcccaggtactgggacatgtacttcggagcgtcttccatgatgcgggcgaccatgagaccgacttccttggcaatgctcttgtggcagtccaggtacagggcgtcgtgcacgttgttgacgacaaagaacttcgacaggaagtccgggtgctggattgcccagcgcatcacacgaccagcggagagcgtcattaggtatccggcctcaccctgacaccagtagttggcgatctgggtggccttgtaatccatgacccgctggcgcagttctttgttccagctgttgtgctgccggaagctgtagcaggtaccgccgtcggcctggtagtagccccgcttgtagatcgtccagttcccgttgtcatcctgctcgcggcagaggccctcgggtaggttaccggtcctgacgacctcctggtacaccacatcacggaaggcgatggcgcgcgggaacagacgggcctcggcctccagaaactcctcagcgtactccagagagacgccggtagcgtaggcgatgccctgggcagacgcaccgtactgcgcagcgaagctcggtggtttgatctcggtccgttgctgcttgatgctgccgtgctctgggtgctccttgtccttgtagatcgccaggatctcctcgtaagggcgcttgagtttggcagccaggcgcagacagtgcatgtccgtgccgttcatcaagtagcgcagcagggcctcgtcgcccgacagcgcggcgagcataacgacttccagggcggtgtagtccacctcgatgataacgccgtcgtcaccgaagcggctggtgaacatctccttcactcgactggataccacaccgtcgtcgtccttgtcgccacgcggcaagttctgcaagttcggacggctggacgataggcggccagtggtggtcgctgtcacgttcaggctatggtggatgatgttatccggccccacgaactggagcatacccttgactttcttgatgttgccgtgcttgtcgtactcgtgcgagatgtagtacgtgccgttgtccttctccagctgcgcacggcgcgataggagcttggcagcggcgaagccgtgcacagccaaggcgtccatcacgtcaccgctggtgctgaacactggggtaccgcacggtaggaagcgcttacccacgaactcgccattgcggcgggcctgaggatcgtaagcgaacttctcggccagagccggggccatgctgtcgattgggatcaggccggggaaccggaaggtggtgtcctcccacttcgtttgtggcgtggtcgtcgcgaccttgtgcaccttcggcttacccttgttcacaccagccttgtaccggtcgatgttgccgtgcaatgcaacggttgcagcaacatcgtcgggatggaggctctccacaggggcgtagaacttgtccccgaacttgtagcagtccaccttctcgaacatcgagttgccagcggcatcggttcgtggtacgcgggtctggtacttcacggacccaccaaacagcaaggcgctcaggtggaagtcactcccccagttgaactcaaaatgttccgggagtgcaggcagcagcttggtgatcttggcgtcgatctctgccagttccttggtctgcgcttccaagttgcggtgcgccacttcaagatcgacgtgcataccagcggcttcgcagaacgcaaagaacaccatgccctcgcagcgctccaggaacatgcgccacattcccatcttttgcatgtaggccatctggccatacaggagcagcgccgtgttcccgatatcgccacgggtacctgcgctatcctcgccacagagatactcgtgcagcagtgctgggtcgatctggctagtcaggacgccctgttcccagagcaacttcacggcgtccagcttggcggtaccgccgtacttgatggccacctcacccagggctgggtaggtcacctgctgatgcgtcaccaggtactcgcccagggcggtgcagatgacgcgaccgccgcgcttgagaaacttcaacagttcggcgcggtagtgcgtgatgaaccagctcagctcgtacatggcgttgtgcgccacgagcagatccacgccgtccaggttgaaccatggatgtccagcctcgatgtcgttcaaccactcggcgcggctgttgaatcgcttgctttgcacgatgccgatctggccatccacatcgtcgcgccatcctgcctcgacgatgtagttgtccgggcagtgcggtgacgccaccataccgagatactcgtggttctcggtctcaaggtctagcgtgcgtattctcatagggcctcctgcggcgcgctcggctctgcgctggcggatagggcggcgagagtcctgctttcgagaagctccagaggcgacgctttgagacctcctgcgaacatatccaaccacgcacgcagcagcgcatcccgctcggccagttcggcgcgcagggtgtcgcgctcttgctggacttcgccatgtgcttcggcagcaatttctagctctcggtcacgcaacgaaagctcagcacgcagctgctcaacctcgccaggatcggcgtgggtgtaatgcgcttcgaccagcctacccatggcaatgtaaaacatgtcgttgtcgcggtcgtggtgcggggcggccttattggccatgcggatcaaatcaccatccccaaggcgtgcccgctcgccctggtgctgctcgctcatacgtcatacccctggcaccaacggtgcgctaagctgatggcctgggcccgcgatttgtatcgacggagtataggttcgttaacgtggtcacgcctgtagatgacctgattatcaggccacacgccacagtaccgtccggtacctttacgcacctggattccccactcgcgctcgatttgttgtacttggatcataccggtaccctcggcggccagtgccacccgaagccaatgttcatgcgacgggtcaccagcactgcccaacccttaccgcgcttaatgtgtggccagtgccacttatggtctggatgccagtacgctgccacccacccgcaggggtggtcaaaaccgaactgtttcatttagcctctccaacaaggtggcccaggcttactgggcgtacaggttgattggtagggacaggtcttgcagctcatgctaactcccccggcgcgctgtccaggtcacggaaggtgacgaacttcggatgccgcaagctacccgaattggtgcgctccatggcttcgatgcgggcgacacggcccatataagcgccgtgcgcgtctatgatctggcctgcgtgtacttcggcggtatactctgcgatttgcgcctgagtcagaccggtggcgttgctctcgctaccatcttcgagtcgcacacggaagcccacgatcttgccttcgttggccttacccgcttcgccccacacgtagtcgatgaccacgccgtcaccttcccaacctggcgcgccgttaccgggcttgagcttccattgtccggccaccttaccattgcgcacctcagcacgcgggtccttgacgatgatgccctcgaaaccctcggcgcgtgattggctgtagagttcacgtacaccgtcgatggtctcggttttggcgatagcctcgcccacgaacaactgcacgtcggtggtcaggtgcgttataccgccgagcttacggctgatcccagtcagacggtggccataacttggagtcttaccatccgactttagtaggtcctgatggcggtacaggtccaggatgacaaactgcggggttgcatcctctggcagcggcgcgtgccgacgcagcaggccgcaggcctcctggaagtccttgccagggatcagcagctcgctatcaataactgcgtccacagccacacccttgtcattccaccaacgcaggatggctgggtacatatcccgtagcgccaggatctcgtgaccggcacgggtcaccgccacgacgttctcgaagttctcgccggtgcggtacaggtggcagcgcatgccgtccagtttgataccgacgagcacgtaacccacctcgtcaatgaccgcctggatggccttctcgttccagttcacagcacgatgcgcatcggctgctatgattggggtagccttagccatcagcggataacctccagttgggcgatttggttattgtgttcgcggcggagtgcctcgatgcgtgccgcgagatcagcttcgctacgttctacgatggcgtgatcgaccagtaccttgtcgaatcgacgcccgcgcagctgttcgtgcacctcgtcgagtgttcgcgctccgaacacacagatgttggaatacacctgcggacgtagagttcgcagccagttcgcgatcatgccctgtgggggtactgcaccgtattggaacagcgccaccttatgatcgacagcccacaactgggcggccaggatagtagccatactgcgaccacttccacgccgcgtttggttcgttggagtaatctgcattacacacctccatctcggaattggcagcgcggggcgtcaaaggccacctcgccttgtacgtgggaacgcttgcccggtagggcgaacttgttctttggtgtggacaagccccggattgcgtaggcgtccgggttgtttagcgcacccaacatcaggatgatatcggtggcaccctggataccggttttggaatccttgagatgactgtacgccgggtaaagctggtcgtcgccgtcattgctgatctgacaggtaccgaagtggatgaagtcgtgacggcatgccatctcacggatctcctgccacttgttctcggtgtcctgcacgatgttgccctggctacccggcatcttgaagttggccagcatgtccgtgacgacgatagcagggcgcatcttctcaatgacttgctcgatacggctcaggtccgcgccgtgcatgtccttgatacggatgcgatccttgcgaccacccatcttcttgatgaagcgctcctccagcttaccctcgtgggatagcttgtagagctcatctaccgtcacgtctagagctgcctggtacacgcgagggatgaggcggcgccccattccctcgttgttcagccataacagtggccgatcctcgtcgaagtatttcgggatctgcgctgccgtgtacgcggcgatgaaggcggtcaggcttgacttccccttatctgggcgagcggccagtgccacagatgcgccgcccaataggcccttgatgttatcgcgcagtagcgccgtgggcagcttcacaccgtagtcgccagactcctcgtccaggatgtccttcacgtcgtcctgaatccactggtcggcggtggtctgctcctgcaacttcttggcctgctccgtcagcttcgccatctcgtacacgagattgatgtcctcgcccgcctcgtggcgtagtgtcagggccgctaccttaccccggtagtccagctcggacagcagaccaacgacaccacgcactgtctcctcgtcgattggttgccgcatacggtccacgaacagcttcaccagggcgaactgctccggcgtgtactgcccacgcaagcggataaggctatccagtgcgtccaggtcgatgaaatcgtgcgatgggtacgctgtccaatactgcgccatccagcccagcacgaactttgcctcgtcgccaatcatggcgtcgggtacggcaccgcgtaacagccggtacttgtcccgctgtcgcagtgcgtgcaggattggaagttccatcacttctccttggatttgtaggcgtcgatgatgttcgcagccttgccgacacggcgcatcaggttggtaacctcggatggacgcacgttgaagatttcagcagcgcgcagccggtggaagtccacgcccttttgctgttcttggccgcagccttccagggcctcgatcacgcggcgctgggtatctgtgaagtccaccccgatggacttgataccacactctttggcgggtatgggcgcaggggtgtagcgctcgcgccaacggtccgcagtacagtaaccgccaccggtatctgtggtgtagtgcacgcgaccagcgcggcccagactcgggacttcgaccatacggatcctggcaaggcgcccatcccgcttgcggcgccacagcgaaccgatgttcagtggcgcaggcggcttcgggatgttcggctgcaaagcgccgatacgtcccgtggtagtaccgctgtattcctggatacactccttacacggaagttcgaagcacatactgtatctcctctttcgtcatatccttggggtctttaccccgaggcgtttggattatacgggcaggaaggcccataccacgcgctctcgcgctgattaacttcgcacccttgtcaccggcagggtcgccgtccatgaagcaccagacggccttacaaccgccttcgaggaggtctcgcaggtgcttatccgacagctccgtaccaagggcggcatgcaccactaccccggggaggacctgccgcactgcccagcgggtcttaagtgcgctcagcaggtcctctgtgatgatcgcgatgctacccacagggtcacttggatgcgccccataggcgggcgctgggaagccgtagccacaccacttcgggagctgtccccgagtagctcgccctagccagcccagcttggtgccgaacagtaagcgcccggtcttctcgctgtaccacacggcgatatccggggccatgctttgccagtcgaagcccttgctcaacatgagcttgtactgctcctcctggacgtggacagaccatgccccgagtgcctttgcatcggctggccagggcatgaatcgtttttgatccgggagtgcagacaaggttgcatgcgacttcatctgcactgcactgcggtgacaccggtggcacttagcaatccaccggtccggtaggttgtacacgaccatggccggggtggcctcccggttatgtcgaacccgtttgctctgccccaccggcagtgcctgcgcttgcgctagccactcgtggttggggattcgcatcgctcacctcacaggagttgattacccaggagaccgccgaagatgatggccagggtacccatggccagcgcaacgttgcgccaggtacgggcgttgccctcgtgatactcgaccagggtatccaattggtggatagtggcagcctggcgggtgatcttctgccggaactgctcgtcagccagggccaactgccgcgtcagttggcccttgtcaccgaggatgataccgcgttcacggcgcagatgcgccacgtcggcctgctcgcgttccagctcgtctcgcaggtcttccaccagttgatgggcgcgtgcctcgatcagctcatgctcgcgccgggtggcttcttggagcaaggcggtggcctgatcgagttcacggatcttggcgggcacggtggccaggcgggactgcaatgcggcgcgggctttggcgactttcgatttgcgtgcggacatggtcttactccttctcagggttgattggtacgatccagcccaggtcgcgggctttggattcgatgtaggcgcgacgttcatccgacacgtctgcgccaatgaagcgcagcacggcgttgccaccacccagataggatggctcgccattgcgcaggatgaattggttcagattgcagtcgaaggtgtcgattgcggatagcaaatcgttctcgtaggacacgagcacatccacatcgagtttacctgggcagctgaactgtagcacttgcttccaggtgctagcctcgccagaggcgtcgtcgctggcgtccagcatatagccgtgctctttcatagcgaccaccagagctgccatgtcggcgtggccgacgacaatcacgtcgatgtccttgggcatcaccccgaagaacaggtcgcgggcgtagccaccggcgatagcgaattgatgcgggagtgcacagcgcccgagggcggccagtacgatggcagcgttctcattcagggtcatgatgacctcctggttggtggagtctagccagcggagggcacgccgcagcatgccctcgacttgccttactcggcggtttgttcagcagcgtaagtgctaggctgctcgctggcggcgtaggcctgctcgatctcggcagcggtgatcacgttcaggatctgagtggcctgcaggacatgcacctgggtgtcgaagcccgagcccacgacgaccttgatctgcttgcccttgccctcgacctcggccacaccgatgacctgggcgttcagcagttgctgggccttctcgcccttgccgatctgcgcatccacacggtcaccggcgctgatgccagccagcttggcctcggcggcggccttctcgtcgaggagcgtgatctgggtcaggatctcgttgtacttggtggcaagggcattcgccttctcgaccagaaggtcgcgcttggatttcggggccggggcgggtgccgctgcgcccgactcggcgccagcttcggtacccacttcggccatcagcacagccagggacagagcggtgaagcgattgaatacggaacgcatggtgaatctcctttgcaagttgtcgggcggcgaactcccgtgaatagccgttctcaatatgtactgtcagtatgaatcgcggcggccagccgcgcccgctaggtcacgggccaggctccgaggcaacgcatcagaagaacccgaaccggttcgcccaatacgtgtgaccctcagggctacgctgccatgggaatagcgatgcgtaaccctccacagaatccggtagtaggttccgctcagcccactgcgacatactggcccgcacgtagcccgggctgcgatcatagtaccgggccacgtttctgacgtaagcgcacaggtccgccttcacgagcttctctgcgcgcttgcgccccacaccttggcgccggtagtaatcgcggaaggtgaccttgagttgctgcttggcgctgatcatttgcgccaccgctctgccatgaacggggtgtttacagcgacagctacggcaaggagcagccattggaaccagtagttcaggctacccttgaagatcaagtctcgggcggaacagatgaaaccgaggactgcgaggattatgatgcctcggcgcaggattctcagcatgggaagaacctcatgtcgatgatggtcacaggcccaggcaactcgtgcgctgggcgtttacgtttgggcagggagcggcgccattccttgagccgttgttcacgctcaatgatcgcgttgcgctcctcccgtgtggtgctatgcgtgcacaactcttgcccgactgccgcacgtccgccattcaaggtctggatcatatcgcggcacccgagtcgagcaggcacttctggtacatgcgcttggcgacctcctgtacctcttgcgtggcagccagcttcggggttatacccgatttgcgcgccacgatctcgaccgcctcctgacaggcctcgatagtagcacgctgggattcaccgtagtgcaggctatagcccgtgggttgcgggccggttggctgcggcgcttgcacggcacagcccgtgagcaggatggcggcgagagccgcagccaggcgcatcacactatccgccagccgcgcagggtctgggaaggccccttgacgacagcatagtgaaacccttcgagggtcaggtccagcaccaggtcatccgcctcagattgcaggttaaccttggcagcgatgccgtagtcgcccgtctccaggttcacaacgctagtggtgaaatcacctaggtcggccagttgtagatccgcttgcacttgactggcgggctggccgggcttgtacgccacgaccacgatgccttcgtgttgtctcaccatgtttctcctttcagtacacgactgatacttgattgacttacaccaaatctacgggccagcgcagattgcccgaacgtcgcgtcacccggtatgtagtgtgctcgtataaaactgacgttgtattcagtcaacttcgccatacccgaggcttctcgcgaagccttacgtgcccttcccttgcgacgacaatcctctagattctgcgcttgagtgcccagcactagatgggttggttccacgcacgccgggttatcgcatgtgtgcattacgaccaatcctgcaatactagcgtacggcaagctgtgcgcttggcagtatacccaacggtgcgcgggtagtcttcgacctcccacaaccttaatgccgtaaccggtctctggtcggatgtacagatgccaccgtttacacggtagctgtcgcatttcgcagactcctctgtacatgcttgatgacgaacgcgccctggtcctctgggaagcgccctgtgcgacgttcgtagttggtttgaccgaaggtatcggcgtagtacacggcgcccactacggccttctgaggcgctcccagggcatgccacgcttgggtgcactccaggaactgccagagtcgtcgatgcacctcgcgctcatccgctggattgaagcccaggccgtacagcaggtgcacacaatcgtgcacggtgcggaaccactcgttaccgccgcgctcgtagagcgtgctattgtgcaggctggataccaacagggtctggctcttggtcacggcggcgagcatagccccgagcccctcggccacgtcgtagggttcgcgccctacagccttcggctcaccgtggttcaggtggatacccttggcgcccaggcactggcgcagggttgggtacgcttcacggtacatcttaaccagcgtactgtgtgcggcgacgatctcgcggatgttcggtttcatggccatttactcacaatgggtggtagttggtcgcggaaacgcaccggggtatacaccgcgcccacggtgaagattccaagtagggcgcactgtcggtaacccggtactcgatcaacgggttgcactcgccaacccgcagctatcatctgctgcgccctttcgcggctcaggtagcggtccttcccgaaccagcttccaggtactttgcggcttatgcggcactgtacctcgacgatcggtttcatgttctttgtccagattgaagtgggagtgcggcctaccaggcataggcgcgtttgttggtgcggccctggccacgttgttcctggcgcttgcgctcatccttgcggcgttggtgtttgacctcatcgccttcggatcgaattcgtgtagggcggatggttcgttcaaacaccggtattctccacgcaaagctttacaccgtcggcaatctcgtaacggaaaagcccatttgtaacgaagtccagctcggctacgcggtgccgcgcaacgccgtcacaactcaataacagcgggtctcgcgctgtagccaggacaataccggcatattgaccgttgccgtcaaatgcggagtacagctggccccgagtaagttggtgcgcttgcagtcttgcgcgggcgggtttatggatggtgatcatcggagtgtcctcagtgtgccttcgccattgcctcggcacctggtactgcacgggcggcgacgagatcgaaatcacccagcaactcggcgcccaggattggcaggcccttagtctgcgcttgggcgacttgcttgcggagatgtgcgagtgcagcgtacaggttgaactcctcgactggcggcttctcttgcttgaaggtataccagggctgcgcggctgcgccttccaggtcggtagtcgcttcgcgattgtacacgaatggcatgtccttggccgacttcttgtcggtgttaacctttaccttgccgaacatgcacgcccactcgaccagcgcattcttgcgggcgcccttgggcatcgcatcgaacaggcgcttgaagatggtgtagtcaccgcaggtctcgatatgatgcaggatcgagatgccggtcatttgtatggcctcatccaattgtttgccacgcacctggatagcatcgatagcggcgttgatctgagcggcacccacgaaggcgacgtttggacggatagctactggggtttgcatgattagatacctttgccttgggatttgcgggcattgtgcccacggagaatgttgcgtgctttctggtcacgaccgactacgtgcgccttccctttcgggttgaagtactgaccaggcgtaacgcgcttatccgtgtcgtaccacacgtcgcgcatgcgtttcaactcagccctgccgctggccccttcgctttgaagggcagccaccttagtggcgcgcttaccagcggcgtagcgcttcatatcctggcgcagcttggccgccttagcttgaccttgctcgatcttgctagtcatgtcgtgatcctcggttgacattcttgaagcgcctagacctgggtccggccaggacatgctaagcaagcctaagcgctttaaggatgtcaacgaaagggagtcgctacccacacgttccaccatccagtcattaggtcggatgggtcgccgtgtggcgcaggactcgacttatcgtcgtatccacttcgatccctgtgcataacccaggacgggaagttaccgttcgactccgtattacgtatccccaggagtctgagcaggggtaggcgtgggctgagcccttctttcgcagcggcctattctgtacagttcgccttcacagtgcgactccaacccgaaagccttcgtcgtcttacccgatccaacccagcccgtttgctggagcttcaccaaccatgctatccgtggtgtcgcttgcttctgtagcgcctgccgggaatgagccggtcacgccgtgggtttccatgttggtaggtttcctctaccttgtgcccatcttaccgactgggctgttgcttgtcaagtggctgccatcttgtggcttacggtgttgttggtccgcctaagcgttagtgaccgcatcccgtctcgccagtcgatccaacctcagcctcgacttgccaacatcttatcgcgcttgctccaccgtgtcaacccttccgcctgtttggcgtatcgtttgagccgggagtgcaggacgtgtaccgttgtccgtctaacctaggcccttagcctagctacactgccgtggtggagcgtgttactgccgacattatttgtaagtggttacggcgtccactgtgttgcagatgttgcggactctacagcgtgttgccttacctgtcaacccttggaagtccctggctaatcgaaactagccaagcccgtagggcctaagagggttggtgcctgccggtcttacccttgcctctatggttgtgaactctacagtagggcgatggctatgtcaagcggcaccggctcctgtttagcggcgcgttgctcaaaccactcatccactgccctacgcacctcagcgcgccgcgcacggccccgctcctggccagcggctatcttagccttagtggcgagtccgtctgcccatgcttgttgtatgttctcccgctgggtgcccatgcgtaggtggtgcgggttgacacaacgcttgttgttgcaggaatgcatagctatctccccttccccgtggtagagcatggccaccacccggtgcccctggacttgcttgtacctcactgtcaggtgcggatagccccgtgtactaaccgcgccatgccatacggcacaagcgtcaggtgtagcgctagccgccaagtctaacagctcaaggtatctcttgtttcctctaggcatacagcctcctctagtggtctggtgtatgtgacctattatgtattcaattagcaaacccagtaaagtggaaactgtcacatactccgatgaggagcgaggagcgagcgaagcgagcaccaagtgaccgaacgtaggtaataccaggatggtaggaccggagagaagaacggaggtgggatgagggacccaccatctacagagtagagccagaggatacgtagcagtacctctcagcacctgggcatagcagcaagtcgaaaagggtatggccccacgcatgcacccagcaacagacagcaggcggctggaatgtgagcgctagcgaacccagtcaatagacaagaagagatatcagagctatgatgcaggcacagggcagcaccgctccctggtaaccgaggatcacaacatgcagcctaacactgacagagccagcacctgggaggccagggccaccgccctagcaatcaccgccctggtactctccctggtcggactggtagccttggcctaccttggcctcaagtccgctggtatcgcaccataagaggttacagccatgtctcagcccatgcacccaacccagcagtccgtccgcatctggcaccaggcccaggccgagcgctgtaaggctatctacctggatggcgccctggtactcaaccaacggcacgcattggccctggcgcgctggtacaaccgccatctgtcccgtgcctaggctaccctacgccctggccctagcgttgctcacagcgcatcctagggcctcgcagggctgcacaggctaggccgacaaacggtagcacaagggcttgacagggcggccaggaaggcgcatactaggcccatagcagcgaggagcagcccaggcagtaccctaggccatctcccaggcaaaggcagcacccagggtcctctcaggaggccatgggggaagctcgggcgtgatcgggtcggaccaggccctcgcatggatacaacaaattttagccgggagtaagcacacgcacgccctaccgagaggaacgcacgcgatacacgcgaatcttcccacccgtgtgcacatcacgcttcgcagccatcttcacggcctcccgcacagtcttgccacagtcgatggcggtgatcgcatgatccgctcccgaacctatggcaatgggatcagtatcactgaccgcgctacgccacacgcgaccatcatcctcagtcgcagctaggtagacggcaccgtcgggagtggccacgatggcgctcacatccagatcaccgtagttcgtcccggtcaggaatgcgtcgatgaataacggcatatctggtctactgcctgctaggaagaactggtggcctgctacgacgtgacgcttgtcggaatcatcggagcggatactgccaccggcggtggtcctagagtcacaggcgatctcgcccttgtaatgcacgatggtagtcatagttcacctcgcgagtaatcagcggaaggcactcacgcgactgccttcgacttattgctcagttccagggagacaccgggcgcgctacggcccgcacagcgcggatgcacgcatcctcgaagtgtgtacgggccagggccaagtctcgcttgtctacacctggcaactcacccagctgcttgcacagcgccgcgatgtctgcctctagtgccttaacactgttcatggcgtcgatctccgattgactcaggtcgcggtagcccttgatcttctcgtgctggtccttcatagttcctcccattcaaagctatagatccccgaggtctgtccagtcatgacgatctcgaagtagtaatccccggctggcagtacacgggcgttctggtcgatgttcgagaacgccataccagcaccactaccggagtctgcacggaacagctcacgctcagtaccgcccgtgaacgtaccgcccgcctgcatgaagttcccttgtacgtaggcgagggcagcggggctgtagcggttcttgttctgctgcgtagcggtgtttgtccaggtcccggcaggcgtggcaccagtgaggacccggacctgggccaggccgtcatcgacgtacagcgtctgtgctgtgaggatgaacggcttgctagctgcgaagcggagttgtacagtagcgcctgtaccggtgaagacacggtactgccggaattgccgaccttcccacaggccgaggctttgcagctgcaccaacaaggcgccccggaatgaccggagcacctcacgagtggccgacaggatcgaccacaggaccatcagctggcgctcaagacgatgccggtgatggcgccaccggagatggtgaaggtaccgaaggtgcccgagccagtcacggtaccgacagcgaccttctggccggtggcgatcacaacctgggtggcggtagtggtggccacgtcaacagccgctttcagctgcgacaacagggtgtcgatcggttggtaggtaccagccacgacttgcggatcggtgcgcaggttggtggtgcggtagtcctgggtcgcgtagcgggcggacttggtgacgcggtgggcagcacgaacgatagcagcgcgttgagccgaggtgatggatgcgtaggacatggtgttactcctttaccggttagggatgggcagatgcccgttcattgcattgcagaggtctacagcgtcggcgtagtccaggaggcccttagcaaggccaccagaggtcttcgcgtctaccgtagggtgaacacaggggacgaactcaacgacagcggagccgcttgcacaggccgtcagagacagcgccaggcacaggctcagcagcccagtccgggttcgccccaatagcttcgtcagcttcacggcgcgcctccttctgacgtaggacttctttggggatgctcaccagacggtcccggagggccgtattagcggcgtttgcagcgtccagggcctgacgtacagcctcggcctcagcgtgctgccagcgcccgtacaggacgccagaggcgccagccagcagacacagcaggcagagtccggcgatcacaagtcgcgcacgcatagggcgtactccttcgctcgacggttctcaaggccccgtacaggcttgcccttgaccgtagccttgaagcccagggctaccccgtacttaccctgccatggcgctacaatcgcattgcagacgccacgccagtcgctgcgggccaggggcgccacgaagaccgggtgcacccagccgttcacgccgacgttgtaggccacggacagcatggcctccttgacgctcaacggggcctgggcagggatgtagcgctcgatacccgaccagtgccgctggacggactggatcagcaagaggttgcactcctggaccgtgtagcgcgacttgggcgtacccagcgtctcgccatagcaccaggtaggcaccccgccgatgtcggcgtagggcgtgagctgcgggcccttgggaccggattcgataggaccgaggaaggccccgccaccagcaatgacagcagaggccccgagggcgatcaacgtttgtcggaggttgcgcattcgagtttctccttccgcttggctgcccggatctcgccaatggccttatagatctggagacccaccaggacggcagtcatgatgctgacgatagtggggagggcgcccaggatggcggtggcggacaggtaggtagtggcaggtgcagcttggatcgcacgatctacggcaatctcacggacaaggctcattggcgtctcctcatggcgcggtgcatgcgctgggtgggcttgtggggttcatgcctgcgaccggcagtgcacagtgggtcattgaggaagtccttgacctcctgtgcctctcggcgcttggcttcggcctcttcgtcaacgacgaggaagccaaccaactcccgtaccagcgcctccacggcgtccagtcggtcgtccttgtcaagcgagccacggtcagtggtgatgttgtgcagctgatggaagaacgagcgcacagtgcgacggtcgttcgggtactgcttgagcagcgcctggtccatctccagggctgtcatatgcacgatcaggcggtgccgttgaataacagggcgaagcgtatccacgatgcgcttctctttctgaccggaggcccagcgctcatcgacgccgcagcctgtaacacgtcgccgccctgtaacggggtcggtgccgttgaagtagttctggatgatcttggtgaccgcaccggcgcccatgttgcgttcgacgagtacaaccttgacgccaaactgctggaccagcttggttaactcttccaggttgctatcagcgaagccgcccttgtacccaccgacagctaggaggtggatgtacgggccaactgtgccgccaatggcaaaggcaagctcgtcaccgccgtcggacgcagggtccacggtcatgatgacgttctcaatcgaggtgaagtgctcagccatgtacgcagcgtgatacagctctgcacgctcgacgctgaactccttcggtggctccaggcggaaccgtttatcagcagcccagctgaaccgctctgggactgcatcacgctggccatcgaagaacacgagatccttcaacttgagctgttgacgcatagcgtcggacaacgtagtgtcaagcatgtactggagctggaagccctccggcccttggtccaactctttcttgcagaggtccgcctcggtgtagcgctccagatcggtgggcataccgcgattgccctcgatgccgccaccgctgcgtaccttatcgcccaggatagccaggcgctcgataatgctcggggccaggtactccccgtagcgctcctgctcttcatgggtcgggaatcgtccaggccagatgcgcaacgtgaaaccacgtcgcggcaggccgttgtagatggattccttggtctgaggcgtacccaggtacatgatccgaccgtgggtacagatcgacgagaactccttcgacagcttgacgaggaggtcgcgaccggtggcggtcaggccattcttggtagtctcgatgtcgtctggaattagcacgtctgcgcgataaccttgaaggctaccggtcaagccgatgcagttcacagacgcggacttctccacgcccttcaaggaccagtgcacgtcgaactccagatcggaggtacggtcaccggcgtacttatcagggcgcagatagtcgagaaggtcccagtgcatgatgagacgcttcatgaggatgccgttctccttcgccttatcttcggcaccggagaccagcatcacacggcacgacgggttctggatcagacaccagatcccgtaaaggcaggcgatggtagacttggcctcaccccgttgcgctgcgaccatttgctcgggcgggccatactgcatgaacttggcgatgtccgcctgcatccaggtcagggagaagccgaggaagctcatcgcttcccggcagaagtccacaaactctggatactggtcgcgcactagttgcgctttggtgaaacgcgctaacggggtaaggtcagatacttgcatcagtgcactccgtattggtccttgagatcctgctcggagagctggacagccttagcggcctgcatacgacgctggctctgctcgttgaaagcgtcgcgcaacttcttgatgtcatcgtcgtctgcggggtcgcaggtgatggcgttgtccttgaggaacttggcgatggccgctttgtcagctgccggtacagggattccctgttccttgtaccagttcagctcgaagatcatttgatcggccaacgcctcatgcagagcctgcatgtgcgttagttttgcggccatatgtactccttagccaagtatgttagcggataccacaatactacctgcggtgttgtttctaatctttagtgacgtgtcaaaccataccccgatgtcaccggtaaccggctgagtctggttacccacagccaccgtgcctcgggtaggggcggccatggagatggtgcgcgtggtacccgagctgttgaaggccaccataccttgcgcaaggtgcgacacgttagaggcgatagtgatgataccacgaccggcgtagccgggtactccgaggtcccacgtttcgcccgcagctagcaggcgaccctcgaagtaatccgttcctgaaatagccgcagtaccggcccgataagggatgcgcgttaccccgcccttgggactggcgtcattaagtggcagagacaaggcaaaccctacacagtcgatgtcggatacgaccgccttcgcggcgttacccgctacactgtcaaccactagtggacgcgtggtaccgaggttagtgcagccccggattgagatattcgacacgtagggcgaaccgcccgcaccagaagccgtcagacggaccagcgccgtggtgatattgttcaccgtacaatccgacagggagaagtcggatttggtggaccacacccgcgcctccagcatatactgcatggagccgatcacatctataccgcgtagtacggtacggtgctgtgtacgcgctcgcgggaaggtcgcgcaggcactaacaagggttcccgctgcaatgtaaaacttgcagtcgctagccacgccagagaacgcttcccagtcaggtgctggctggaagctgataccagttgatgggcatgcggtctgcgtgccgtagtagaacgtgcagtcccgtacaacacccgcgcccacctgcatggcaatgtcttggttacgtcctagggtgggaccgccataggctgcgaacttgcaatgctcgatgaaagcaacctcggtctgcgtcttgatgcttcgaccgtagcagtccgtgaactggcactgggagacattcaagatgttttcggacttaccgctacgggtgccccaaccagagaacacacgcaaaccatcctggtcatcttgcaccgatgcgtcgtctgacttaatggtgtggaataggcagcgagtaacgttaacagcaatgccataccccgcagtctgcgggcttacagtgatacctgtaacacccaccgaaccgacaatacctgcaccagcagccatatggatgttacgtacagagcagcgatcaatatcaatctgccagaacgccccgcgcacaatgatcccatcacccccatcagccgtgttgttggcgcggaagcaattggacacatgtataccagataagtccgcataggcgtaggctgccggaaagccctcggcacggttaaagagccgcagacccacggagcacttgtcctggccatcgatgtacagttcacccttaatggtgtggcgctgaccgccgaggatatccacgtcaatcgcatgcgccagagtaacggttggcgcgtcgaacaatatccgcgcacccgcactctcccaatctaccgcaccaagtgcggtaggggttagtcgccgcgtaatgcgtatgacgtcacctttacggcctaacagtagaggaaccccggacgcgatagctgcctccaaggcgttactgtcgtcagtaaccccgtccaacttggcgccaaagctacggatatggcgtcgcacaccagaatagcgtagcagttcgtcgtggacggtggactccaggaaacctacattagagccgccatcaggttcactgaggtcgaggcgtagctggaaggagctatcgattatggcaccgtcgatcttgtcctctgcatcttgtgcgatctgcttcgcctcttccgcgatgactagcgcctcggcggctgttaccgccgtgtcgttgatcgcctcctgggaggcgtacaggagttgccggttgttctcgtccacataacggggcaggaatggaacgccgctggcgaataggtgctttggcacaatcgccaaggtactgcgatagaccttaacaatggttccagccgcaggtgggacggtcagttgaacttgtgcgatgcttcctgggaggatggtaaacgggacgtttacatcatccacggagacaaacacgtcggatgcgtccaggaatgggaagtggaactggaagacggcagttgtgccgtctccctcatacacgtcctcggtggatggtgtacgtgccatttattctcctttgatagcgtcgagagccagggctgtgcctggcaggatattcatgaaagggactaccatgctggctgccttgccgatgtcgtaggcgccttgacgtgtctcgccacccagcacttcaccaataccgccgagcaggcgaccggggacttccgccaaggatagcagcggtacggtcatacctttcttgtcagaggtcagtcccaggatacccgccgcgtcacctgcgaagcccaggcccgcagtataaccgatagccttcttggctacctcttgcagacccttctcggagaagtcagcgttacctttgcgcgcctcgttggccatgaccagcatgaacgtcaacgggtactggtacgccagcagggtagccaggccgccaataccctcgttttgcaaggtgccacgtaggagcttgttgtgggcgaagctcacgaagctcttgaattggaacatgacctgcccaacggcagaccgcccgatgctggcaccttgccccacgcgcccaaatagcacggagtcgtccatcatgcggagggcggcgttcataaccgcgtcgatgtcccctttggcccaaccaccccagttaaaactggttgcattgcgacctgtactggagtatgtgacgttttgggcaatggcccgcttcacacgcgaccagtctagatcgggtgcatacgacatgatctgcttcaacgccgcgtcgtcgcccttggccgccctggcgaacttgttcaggaccaggttggcattcatgcgggactgctgggcatgcacgtacttcatcccgttcaggtagggcaccgcctgtttacccatatgcaacaggcggtcgagcgccgtgtcctggctcgctaggaaggcatcgtgctggcgcttccaaggacgcagacgcacgtctcgggccaggtccagtccgagaacggtggacatctcgtctgccagatccgggtccttcgcggcgttcttaaagaacgtcttgacgccggggaactggcgcacgaactccttcgcggtctcgaacacgccgtggcgctgggccatggtcgcgtactccccgacctgccagaagccagatgctgtcaacatcgtcgcatctgctaccgacttggcccgctgccaaccttgacccaggatgttagcctcggggcgctggccggtgaagtcaccgagcaggccgtctagctgctgcatcaggtccgcctgctccgcctggggtaggtgcttgatgctgtccgaatacttcttgcggaaggcggtcaagtcggactcatcagcgataccctggcggcccagagcgctgcgcccggtgataccttgcgtgtagttctcgattacccggtccaggtcagtgtcgatgaggtcagtcatcttgtacagggtaccatcggccatgcggatctcggtacccatgtccaggctgagtcgatgcttaccgtacttcacggtgccctggtccgaggccttctgttccaccttggccatgatactgtctatcacgccctggttgagcttggcgcgctccagtgattcccggagataggctgtgtcagccttgcccagtccgcccatgaagtcggttcggttgtggctggccttatctcgcacacgttggatgagcgccccagccaaggcgtcagcctcatcacgctccaggcccttgatcccgctcagtgccgatgctgcgatcaggcgccgggcagatccggcgtggttggcttccatgctgcggatcaggctgtcgttccaggaccggtggaagtagccgggttgtggtgtgaagtcctcgaagccgcgtacaccgctgtcgcgtgccatctccccgagcctggcgtgcagcttgtcgctagcatcagcgaggcgggctacctccgggcggacattggggtcgggcatcacgttgccatagagccgccactgctcattgcggcgcagcagctccgtggccacctcgttctggagagcatcccgatccttgccgaagttcccgttcaggtcgaaccgccgactgaaccagccatgactgggcgccaacgcagcgtccaaggcgtcctcatattccttgacgaggccatcagcctcattgcggaacatacgcaggtcagatgccgcgttgctgttgctcagcattgtactccggcgtactgggtcgtccatgaggatcttcatcaactcgcccgcctcggggctagccgtactcagcttgtcgaactcgctaaggaggctgttggtccaggagcgcatggcaccgggcttcgtggggatgttggcgccgccataccagccgcgaggtgcgccggtcccgaagagagccacgacgccaccggtaataccggcgttcagcacgtaatccaggccagtggtatccttgcctgccagatcaccagccccagtcaaagccgtacccgccgtagcgcccattacaccggcggccacgcggctgagcttgtatgcccgactggcaccgaacgtaccaaagtccaccagcagctgggttgggtccagcatgcccgaggccagcgcccagccaccatgtcgagccagtatctgttggttctgctcgtggcgttgaatgcgttgcgcagtggccacctggtcgtctagggtaccgctacgtcccaatgcccggaggttgtcctcagacggctcgatgccgagctgggtcaccagctccatagcgtgacgggtagcgtcgaaggttgggtcgtactgttcgaacgcctggttgcgggcgttgtccgctgcctgaatgatgtagccggtgtaggactcctcgacagctgcttcgaacaggcgctgcgtgctatcgtccgcctcggccagcgcggcctcgataggggcctctcggatgcgtacaccttgctcgacctggaaggccccggcagggcctccagtaacgtcggccatgctggcagtgagttgggtagggtctactggattgagcgccgcatcgagcgtttctgcgcccagtacagggggttgtttcttggccatgcggcgctactccttacatcagttcttggaagtgcggggccatctgttcgatgaaccactccacacgtttaggggtttgcttggcccagtcgctggaccgtacctcggacttgaaagcctcgaagtcacgggcccggattgcatcggcggtacgggcatgttcctggagccccttggcacccagttggaaggccgcaccggcaagcccggctactgcccttgggttttgcacaccgagctgtacagcgtactggcgggccgctgcgagcgcattatcagtgtcctcgcggaaccatgcctcggcctgggccaaggtgatctggtcgccctccttgaggttggtaccggtgacgttgtggcccatacccacagcaaggccgttgcgatccttgtagaccgtgaggctgagcccctccaagctcgccaggtccttgcgcaggttgtacacgttgcgaatcggcaggccctgggtgttggcaccatcgatcgtcatgttcacagcggattcggaaccgccatccacacgccgcacgttctggctgccaccgaagtaacccgcacgggcctcttccagaatagcctcctgatccgcccggacggctttaccaactgcggtggcgtctacccgctcaacacccacccgcataccgttcttgtcgaaggtgacgcgctccaggtagccgagggtgctgttgaagctgtagccggtctcgaagtctgagcccagcacgccctgggcaggtgccggtgccatctccgccaacttgcgcccaatggcaaccttgtcacttgtcccgaagatttgctccggtgtaactccccgtggtaagatcagtggacggcgagcctctccaccgaaaccgagggtgctgggcaggccgacctcgatagtacggttcttgacgttggttgcagccgtctcgacgtaggactctggggtggcgccgaacatgtccttgttcatggacatgtagttcgcctcctcctggatggccgcagcccattggcgctgagccgccgggttatcgctcaggttgctgttgccagtcaggaagttaccgatgcgaccccagaagcccgacgaggacgccccgtcgatctggtcgttgattagcttctgcatgtccttgccgcgcagcgacttctgcaaatcgctcaggccctggaacgcctcgcggttcgcggcgtactccttgagggaatcggcaggacccacgccgaactgctgctgttgcagcgcgtaggacatcgccatacgggtatcctctggcatgctctggagcagcacaccacgggcgcctgggttggattgctcggcgactgccagcgcggacatagcggcattgaggccggataccagctcctcgttgagcggttggccctccttaagcagctgtacgtgccgaactgcttggccgatgctttccccgtagacctttgggattgtcccaagcttggcaccctgcttgataccgaacgtcatccgttcctggatgctgcgcccagcaagggcctgctgctggtcaatcttggtcagggcgctatcggcggactcccctagcgctgccaagctaccgaggtcgccgttgcccacagcctgcacgatctggagcatctggtccttgttggataggcccttgacgtgctgcatggccagcgccttagcctgatcgtaggacatgcgcttgttgttgacctcggtggcaatgtagctcttgaggtcttcatagctgatctcgcccttggcaaccttggactcgatctgagcgttctccagtacgacccccaggctatcctttgcctcggtgcgcacggcactatcacggagctgcgagtccagcgcctgccgctctttaaaggacaggacgttcaacgccccactatcccgaagcgcttcgatcacgtcacgttggtcagcattcgccagggcgctgagatagtccttggccatggtggtccgaacgctggccggtaacttgtccgtggtcaggaggtcggtgtagaagagcgcggcccgctcagcgttctgggtggcagctgggccgccttccacgaggtccgtaatgatctggttgccttgcgcttggaagcgcttggaaccttgctcgatgacaaacgcctggtacgctccggcctgctctgcgaacaggctttcctccagtttctgctgcgccgtgagagcctgcaactgcccttgtgtaggcagactagcaaacttaccggtgaacttggaggcgcgctctcgcacgatcttggcaaagtcctgcgaggtcatggtgcggccttccgcagcaatgaactgcttgaggtcgcgggccatctcggactggctgatccggtagtcctcggtgttgtagccgccgttgacgaagggtgctgagaacacatcggactctacggcatcagcggattctccggccatacgtgctcgctggccttccagatacgcctcctgggcgctctgctcgaccgcctggttggccacctggctaccgatgctcaggaggccgcgcagggcctgctcagtggcagaggcgccctgcacctgggccggttcgtaacgtccggcgccgagattgacgccttgcgatgtttcgcgctgaacgtctagttcaaacggttgacttgtgcgctctaccattgagcctcctacgtgctagtccgtaccgctgactgcgagccgaacttcatgtactggttgagatacgccccgccagtggcgaaggcaacgtcgagcaaggggttggtggtctgcgcagtaacctctccgcgcatagacgcagcagcgccagcgataacctctcgaaggcggttctgcaagttgtactgctgggtctccaggttctgcgcaacggttacctgggcctcacccaattcccggttgatatcgtccgtgacggcatctaccgacgcacccttgacaccagccgccgcagcttgggcaaccgctgtgcctgtagcggatagtgccgccacctctgcctggtgcaactgtcgtgctgcgttggttcgtaactcggctgcttggacgttgatcgcgcctacgctctgcgcggtattaagtacggtctgtctgttggccgcagcgcgagcagcattctcagctgctgcttggcgagtcgctgcccgattgttcaggagcgactggcccagctgcattgccccgaccgcgagaaggggccatagcattactgcctccgatggcgttggttgaacttgtagccgtactcgatactcaggacgttcatgtcgtagtagtccgacgtgtacatctcgaagtttacagtacgcatgtccagtcgagctgggatgataacggtggcgctatccaccatgggttggcccgctgcgatgtcgccagagaatagccgctgaggtgtggtatccataccgatgggcgtactccttgcctggtcagtcagagcgtacacaaactgcccgctgttatacagcgacacagaatagcggtggattaccgctcggctcgtcgtgatggcgacatccttgcggtccttgatgactggcggacttggcgcgaacctggactcataagggaatccgaggatgtacttgtcgcccacctccgcctcggggatctcaatatcaacggtagtcgggcctaccgtcttgtcaaacacagcctgacccaggaacgcattctccccactggtctggaatgcccggagatcgtcgcccatattgtcgatgaaacggggcagcgtcaggtgaccggccaccgtgcaggttagctctgtgaagtagtccagtcgtgccgtctccggtcccgccacgccagcgccgcgttgcagatctagcgtgcacagtgtaagcgtaccatcaacacccaatagcagcagtaatacgtcaccactgaaataggcatcgacgatgggccattgggtggtccatttgtgccacgcctgatggatcttctcgttaccgctccaggtgtactcgtgcaccactagggtgttcaggtcgccctggatacctccgaccaggatgttcgaagtggagctagacgcgaggaaacgccacgggccctggatataccgggggatgtggttcgtcacgtcgtccgccacgtactggctatcagcaaacgagctaggcaccatctcatgcacacccacgaatccgagactacggggagccccgaagaagatgctgcgtccagtggccacaggcgccgcgttggtgtctacttcgtactgcgtcatcagggcaacgttcgcggtgcggggtgttaccagcgagcctcctggcacaataccctggtaccgcttactgaacatcacgaggtccttgttgaagttgatcgcgtgctcgtatggtgcggtcaggttaccctgcgccgctacctcgatagggtcgtcatcattgagcgtagccatcgtgctacggaagaaccgcaggggattgttgctcgcgctcaggttgatgtactcgttacttagcagacccaggcgaccctggaatacgcacagccctgtgataccatcggctaagaacttgaagttcgggttggtctcggagttgccagccgcccgtcgttcaaacgcgggttgcgtcaaggtccaggtcgatccgttcacttcgagtttgagcggtgtgttcgtgatggattgcatggaaccccacgaggcatcctcagtccacaatgcacgggcgaagtcccagcggtagtagaccttaaccttacccgcgccggttgcgcagatgaggttgttggccccgattggcaaacgagcaggcagttccgcaacatcgcggatgctcatggcgttactggcccgcacatacgtgctgccagacgtggtactcagcgtcaccgctgcggtggtactgactacgtgcacatacgcgccatcctgtaccgctgtcacgttgaaggaaccccaggacgagttgatcgctgcgaccaactgcccggcgatgtactctggtgtggactgcgcagcgtggctgggcgaggagccgtccggcgtagtgtaactggccgtcgctgtagcgttgttgatgcggttcgtaatcgtgatggagaacagcttagagtacgttccggcgttgatgtagaagaagccgtggcggtccgggttggggtaggtgctctggtcagggtgggtggctagcgtcggcaattggtctacgttggcgatccatacggcatcatccagggtagcgaatcggatatcgctcgccagcggggatagcaagtaggcgtgtggcaacgtagccaggagaacgcccgtagtatcgttcacaacgcggacattgcccgcacctgtatccacgataacggatactgatacacctgcaatgtcggtgttgtattgtttcaccttctccagcgcggtatacgtcccaatggcggttagagcctcaattggggcgcggcgtcgcagaccggccaccgggtcgctggtcatgttgacctgggtgctcagttggcctggcaggcggtcctgcggggcttgctgactcacgccgaacagtagggaggtgtaggagccttccaggtacatagcacctccttacgtgcagagttgacgccgcagccgctcgaattgcttgcggttgcggctgttctgtttacgggatacggtgtggtccccgttcagttgctcgatgaaacggtcgcggtagttagagatatccacgtaggtctcatccggtccgatgtcattgcggtacacgtcagcggcagccgtgtatgcgatggcatagcgcgccacctgtggtagctgttcgaagtccatgttgaggatcaatcgacccttgacgggctcaaataggaactcgttggccgtctcgctatcgcggatctgcgtacccgtgaacgtgaacttggcgtcgtcagggaagaacttgaggcaatccaacggcaccagcacccgcccatcgactagcggttgcagagtggtcccgtagaaagtattgaaccagtagccctcagacagcacggtgacttgtgcttcatccagcgctggcagagccacagcgagggtcgggtacggttcgtcgatgttggtcaccgggatctcgcccagcttgcgcaggatcaagttcacggcaccaagcttgtccagtggttccataaacacctcaaaaaaaaaccccgcccgccgagagggcagacggggtttcggttagccggtgacggttacgt

SEQ ID NO: 21 - DNA, 40665 bp, unidentified
  misc_feature 1..11: note = bacteriophages nucleic acid sequence
  source 1..40665: mol_type = genomic DNA
ggatgatccaattgattatctcaatgggcctcaatggccctcatagggaatctcaatgggcctctatctgtccctatctgtaagtcctccttgagttccctataagtcatccataggcttgacactgagaccatccataggctatcgcgtgtatgcgctcataaggacccctcaaagactgtctacctgataacccataggatcaggctccatagggatgacctatcagctctcaggcaacgatagaaactcagttgttgacgacccatgattattcctgtctaatggctcccatcaacggcaaacacggtgtgattaacaccacttgagttgatcgccacggtctctggccttggtcctaacggtctcactgagatgaccatagggatcgacaccagagcctataagggccacaagctgggtcgggcaatacttcgagttaccctaaagcatgtgagtagcaacaagggctgaaacaaacgcttgacaggatggtgaaacgctgtagaatgaccaccatcaacaacgcaacacaccggcaacactgagatgctcttacaggtctcgaaagggcaacgaattggctgatagacacggcctaacgggcacccttacgctctttaacaactcggaatgctacaccacgcactgagccggtctcgcctctcagggcaaccatagggaggctgtaggccctcggtgcgtggcagtgataggaaatacagcaagatggtcttgtgtgagccaagcagtagctgggttaccagcagtccacgcaaggagtcagtatcaggaccatcgtctgtatctcccgtaaaccctcactgaaggacgcacgctatgagcattgcaactgacaagctcaaggaccagcttcacgaactggagcagcgcatcaaggtagcgatcaacgaacacgagcaggcaaagagtgccttcggtcgtcttgaagtccctccttcgcatcctatgtggggagtgtttcgggaccgtatcgactccactctggtacaccaaagggtcctgcaagcgctctggcatcgcactaaggctgagctactcgaacgaatgaacgctgacaaggagcctgagtaatggcacaccggaagttctctgagctgtcgaacggtgacactggccgcatcgccaaggtatacaccgatggctgctggggtgagtacatcgtcaagtttcaccatccaaagaccggcacaacaaggccgctgactatcacaccagcgaccgattggacgcactggacaccgcacaacactggatcagacaacaggactgacatcatggcacgcaaagtaacgcaagacgctgtaaacgcattcatcgctggccgcactggtagcttcggtggtaacaccacggtcgaactctctccactcggtgaggtgatcgttctcaagctccacggcaacgccattgcacgccgcgacaagggaccaatgggcacctttgaggtttgcgacggtggctggtcgagcaacaccaccaaagagcgcctgaacggtctaccgggcgtccgtgtgaaccaaaaggactacgcatggttcctcaatggcgaaccgtggaatggcaactggaccaccatcaatgggtgaccattcactcaagggcgctcgctgagtgtcccttggggaagcaatcacgcacaccacaacgcaccaccaacaatcgaaggtagcaccatgtctaatcgtcaactgcaattcatcctcgctcgtgccgcttgcctgctggtcgaggcatacactaagtgcatcgctgagtaccgcactatcctcccactggatggccgcattggtctggacgcaccgagcaccttcgagggtctcaaagcggacgccgctaaggggttcctcaaggtctccactgagttcaacacgtcgagcatctacggtggctctggcaacctgactttccgcaccttccatgacttcggtcatctgctgtacaacaaggagttcacgctgactgacgaagtggaactgtcgcgcatccaatggcaggacttgaagggctatctccctgccgagtgggtggacgtgtgccactgcgtctatgtcgctgacactgagcagcaatcgctgtacgaagccgagacgggcaacttcccggctgaccagaaacgctttgtcatgggcttccttgccgatcacttcgcttaatcaacctctgagaatcaataggtaaaagcaatgcgctacaatcgcaccaacttcgtgtccgctcgtgtcgtaacgagcatcatcaccgccatccaagcggtaatcgcttcgggcatccctcagtacatcgaggatcgcaagggccaacgctggctccgtgtggctctcaagatgctggacggcaagcctcaactggaattctttgcccgcaatgggcaggaagtcggcgacgtgatcttgcaggcgtccttcgattggcacgctgaagacctcaccgagttctctcagttactggtcaaagtttatacaatgaccgagctgcctaccacacctgcccgaccagtggaacctaaagttgatccagagcctgccgttaacctgccttccggtctcgtttcgtggcgtctgccctctggcctgaccctgtacgggcactggcggcgcaagtggttccgcaagcgcttctatgtgacccacgaccgcaacggccaactgccgcaaggtgagggttactacctcgaccctgaagccatgctgtatggcacctgccaaggggtaatcgcatgagccgggtccttgaccatgctgtaaccggtatcgcatcggtggacaagtatcacccgctgctccgtgaacatctcccgtacatcaaggagatggccgaactcgccgagacgcaaggcccaatcactgcggcctgtttctctgagtccagcggtttccaaaagttccttgacgattgcgtggtgtgtcatgcaccgggcgtctactcggtcgcttacctgtcgccacggtactgcgctgagattctcaaggaagtcaagaagttccctcacacggtcaacgatgaggaacccgaggaagcgcagatacccgaggtggtctttcagaacgagcacccggttctgttcgaggtcttccggtccttctgggcagacgctggcgtgacactggcaaaggtgctgctcggtctcgaccctgtgaacctgaccacctgccaagccgctcagtacgtccctacgggcatctcaaggggtcactggcacatcgaccaagactctgacgtaacgctcgtggtggccctcaacgacgaccacaagggcggtggcacgatggtctatcggggtcccttcgcacctgctgtcgaggtccctcagaacgaaacgggctgggcaatgctgttctgcggcaagacgacccagcactacggaatccctgttatcgaaggcgagcgcaacctgctcgtccactggagtgagatcaagtgatgcacacgaactaccaaccggcacgccgtgggctgctggccgagcggatcgccgctgagaaggaagctgcaatcgacgcgaccatgcgtcacccagaggcaaaggccagcgtgatgactgccatgtatggtggtcgccgcaccatcggggcaatcgctgtggcttcccgcttcggcaacatcgctcacattcagcaggctatgggcttgcgttacagcgaccgtggcgacttcacccgctgctatcggggagggttctgacatgggaccaatgcgaatcgcgccaccaccgaccaatcgcgtcaaggaggtgacctttaaggtctctcgcccagacggccaatatggtctccacaagctcgctgacaccacgttcgcccttgggctgggtccctgtggacgctgggtccaacgacttgaggtggaggttacagaccacctgctgaggattcgccagcactccaccgagttcgacatcaccgaggcagccgctgagaactccgaaagtgaactcatgattgcgcatcaccaaggccgatacccgtgtctcaagaaggaactctcggctgacctactggagtttcacaaggagcgatttaacaccaccaaggcgctcttgcgtaaggcgaatgaaggctacgagatcaaggagtttatctacaagatcgcagacattcatggtcggatcgtaaccacaaagtaacgctggatttaaaaaccctcactgtggctgcacacactatgggggcttttatcttaaagacatctcaaaggtcatcttaaagaccgtccgtgtgggcagctcatcgctaacccattcgagacgattaaatgaccattgcaattcccgaacgtcacgacttcagcgacatcaattcgtctgctgctttcgatgccttgagcaacatctacggtcctgcactcgctgctgagcaactccagctcgaacatgaggcttacaccctcggcgaagaacggttccacaaggcaatggaacggcagatggaacgaggtgagttctccaacagccaagtagcgaaaccgctgctcggtcatctggtgccgatgttgtccaaggccatcacggattggatcgaacaccagaccaccaaggttcgccgcaagcatgtggcccttggggcgttccaacagatgaacccagagacgatggcaagcattgtcattcgctggaccatcaaccgtatcgctcaacgctctggcgctccgaccatcactgagatggctgtgagcatcggtggtgcccttgaggaagaagcacggttcggtcgcatccgtgtccttgagcaacagcactaccagaagcacatcaagaaggccctcgcccagcgcaatgggatgacctacaaggtcgcctacatggagaaggtcgaagcccacatgatcgaggcagggcagctcaacgagccttggaccgagtgggaccagtctggcgcagatgtccgctaccacatgggcatccgtatgctggaactgctgatcgaatcgacccagcttatcgaggtcgttcgtgagcacaaaggcaacaagaagctggacggtgagtatgtctacctgaaagcggaatgggccgacaagctccagagccgtgcgtacatcctgtctggggtcttcccgcgctaccagccaatggtcgtgcctccgaagccttggaacggtgtgcgtggtggtggctactgggccaagggtcgcaagcctgtgaccttcatccgtgtcccgacaaagcgagcgctcaaccgctaccgcgatgtccacatgccggaagtctacaaggccgtcaacctcgcacaagcgacaccgtgggcgatcaaccagaaagtcctcgctgtggccaacgctgtgatgtcttgggagaacgtgccaatcaaagagttcccctcaacggaacgtgaagccctgccgatcaagccgggcgacatcgagaccaacgaggaagccttgaaggcgtggaagaaggcagccgctggggtgtaccgaaaggacgccgcaagggtctctcgccgactctcctatgagttctctcttgagcaggcaaacaagttcgctgagtacgatgcgatctacttcccgtacaacctcgactggcgtggccgggtctatgcgatccctgcgttcaaccctcagtccaacgacatgaccaaaggaatccttcaggctgccaaaggcgagccggtgggcaaggacgggatcgagtggctgatgatccacggtgcgaactgtgccggggtcgataaggttgacttcagccagcgcaagcagtggatcaaggacaacgaggaaatgattcttcgctgtgcccatgacccactcatcaacaccgactggatggacatggattcacccttctgcttcttggcgttctgcttcgagtggcaaggtgtgaagctccacggggaagcccatgtgtccgccctaccgattgccttcgacggttcttgctcgggcattcagcacttctctgcgatgctccgtgatgagcgtggtggtcgtgctgtgaacctgctcccaagcgatgacgtacaggacatctacaagctggtctcggatgaggttgagatcgcccttcagtgggacttgaagtacggcaccgaggattccacggtactcgacaccaaagaggacaccggggagatcaccgagcgtcgtgtccttggaacaaaaaccctcgctatggcgtggctcacctacgggatgtcccgaaaggtaaccaagcggtctgttatgaccctcgcctacggatcgaaagcctacgggttcgccgatcaggttcgtgaggacatcgtgaagaaggccatcgacaacggtgaaggtgagatgttcaccagtccgggcgaagcgagccgctacatggctggcaaaatctgggactctgtgagcgtcgttgtggtcgctgctgtggaagcaatgaactggctccagaaggctgccaagctgctggcctctgaggtcaagtgcaagaagaccaagcaggtcctcaagcctgcaatgccggtctactgggtcacgcctgatggcttcccggtctggcaggagtacatgattcccgagacccggcgaatcgacctgatgttcctcggcgacgttcgcattcaagcgaccgtgactgtccgagacagcgacaagattgacgcccgcaagcaagagtcgggcatctccccgaacttcgtccactcgcaagatggctcccaccttcgcaagactgtggtccacgctgccgagcggtatggcatcgagttcttcagcctcattcacgatagcttcggcaccataccggcgaaggctggcgcgatgttccgagcagtgcgtgagacgatggttgaaacgtaccaaaacaacaacgtgttggaagacttccgcgagcagttcatggaccagctccacgagtcccagcttgacaagatgcccccgatcccgccaatgggcactctggacatctctgaaattctcaaatcccaattcgcattcgcttgacagaaggaaccaaacaatgttcgcacgcaacttcgagaagaccaccaagaccaccaaacgtcgctcctacagcgagcacgttgaagcctcggcgcgtactggcaagcgtaacaagccaacccgtggaggtaagcatggataccaagagttcgacgacgcacgctgagtgcatcgagttcaccggatacaaggatcgaaatggatacggcatcgtctcagtatccggtaagaacaagagggcacatcgagttgcctatgagactgccttcgggcaaatcccagcgggccttgtagtccgccacacctgcgacaacccttcctgtgtgaacccagatcatctacgaactggaacccacttagataacatgcgggataaggttgatcgcgggagacaggcgaagggagactcaaggtctaactcgaagttgaacgacgatgcagtgaggttcattagaaactcagaattgagaaactcagaactcgctgagatgttcaacgtatcccgtccaataatctcagacgttcggcgtggtaagcgctgggcgcacgtccaataggagaccaatcaatgcaagtgaccatccaagcaaccagttccgtgattgacggtaacatggccctgatcgagaccagcgtgaccatcggtgaggctgtgaccaccacccgtgtcggctatgaccgccaagaactgctcgacaaccgctatctctcgggcaccttcgaggaacgtgttgaagccctgcgccagtccgctgagcgtatgaccgagaccagcgtcaagctgcacttccaagcgctcgccaagattgcctcgccagaagctctggtgactgacgtggccttctctggggtcggcgtcaaagccactcaggaactcgctgagaagatcgagcaggctcttgaggaagactcgaagcccgccaagaagacccgtaagccacgcacccctaaagccgcccagtaaggagcaacccaatgtccaaagtcgaagccgtcatcctgaacaccaagccgttccgcccaaccgactacaacgagaaagccatgcaggccgtgctcgatgagtcgtacctgcaagtggacgtgaagaaggatggcgttcgcctcaacctgtgcgtctccggtcgcgctccagtggtcaacgtcgagtggctgtcccgtgagggcaagcgcttcccggctctgatccagtacctgcaaggggacgagcgctgggccaagttctacaacccgcacctcggtgaagccctgttcaacgacgaaggcttcatgctggacgctgagttgatcctgctggacgaccacggcaacgagaagaagtgcaagaacacctcgggcgatcttcgccggaaggacgagccggtgccgctgaaccgcatccgggtctacgtgttcgacatcgtgcctctggacgtgatcgctgagggcatcgagtacgatgtcatgcagtgtgtccgtaagggccacgttgagtaccaagtcgccaagctcaaggaatacttccccgagatcgactggatcgtcgctgagacctatgaggtctactcgatggaaaccatgccggtcattgagcgcccctcggttgacgaggatggcaacgagatcaccgtgacccttcagccaccgctgagcctgacacacctgtacgccactgtgcgtgagcgtggtgaggaaggtctggtctgcaaggacccgatgggcttctatcgtcgctccaaggtgagcggctggtggaagatggtccctgacgacaacgaggatggcgtcattcaggatgtcatctggggcacaaaaggtctgtccaacgagggcagggtgatcggcttcaaggtactgctggagtcgggccatgtggtcaacgcctgcaagatcagccgcgcactgatggacgagttcacggacaccgagactcgcctgcccggttactacaagggccacaccgcgaaggtcacgttcatggagcgctaccctgacggttccctgcgtcacccttcgttcgattccttccggggaatctccagcgccaccatcaaggagtaactcaacgagcctcatcgacttcggtcggtggggcttttttgtgctcgtcacgataggagaaatctatgggatggaccgttctgatagtcgcttggaacctgctctggatcgctgctgtttataggttccgatgaccgaatttaaaaaccctcactttggctgcacacatcgaacaacccaaaggaggttcacatgacccaacctgtactgcttcacagcaacaaaggaaccgggcacttcaccgtgcgccaagaccgcgagatcgttaaatggctgggcaaggttccattccatgccgttctcattaacccggtcggcaccaagttcctcgtcaccaagggcacctttgcgcaatcccgaaagctgggccgcattgtgctcaaaccctacaccggcaagttccctcgctgtgccctcgtctggcagatcgtgaaggaggtcttcgcatgagccgggtgattatcgctctgacttctgagcgtggtcgctcgggcaaagacaccctcgtcgagctgctccgtgaggaaggcttcgaggtctatcgggtcgccttcggggatgtcctgaagcaccagtgctcgctcgtcctgactgactgccgtgaggctcagatcgtcatggagagccacatgcacacggacctgaaggatgccaagttcgaggaactctcgatcaacaacatccccgactccgagtacagcgactggctccgtgagaacttctgggacgacaccgcacctcagtcgcctcgctggcatctccagcagtacggcacgggcttccgtcgcaactacaagggcgagcctgacgtgtggcttaacgagggcctcaagctcatcgagaaggccccagaggattccctcgtggtcgtcaccgacatgcgccaagccaacgagtatctggcccttgagggtctcggtgctcatctggtgcgcctgatccgaggctggccaatcgaggctgtggactctacgccacttcacgccaccgacatcgagctgcgcgaccacgttatggacgccgtagtgaagaacgaatggggctatgccagtgacatgctggtccagctccgagcacaaggagtaatcgaatgaaacgagacaccaagatgaagctgttcaaggccaccgtgaagttccgtggcgagatgcaggaagtgccgatctgggctgaatccatcgagaccgctcttgaagtggtcgatctggaatacggcgaagacaacgtttaccggctgcgcccagaggtgacgttatgaaccgcgcccaaggcaacacccggtcgatgccagatggcttcctgcacatccagaacttcaccgtgaccaaacactctggcatggccggggtcgtctacatccacctgatgaccaaggaacaacaggagatcgttgagtcccttctggtcgagcgtgcgacggtccttgaggccatcgctgaggatgctggcgtgcccactgaggtcgtccatgtgaagcacggctgcttccggttccgcaaagagttcctaaaggagaacttccgtgaggtcgttcatgcgaccaccaagatcacccgccagccagtcattgaggacttcaaagggaagctgatcgccgagcgcgaatcgctctcctattaaaaaccctcactgtggctgcacacattcccaactgattcaaaggagacaatcacatggcaaagtccaccaagcaattcctgttcactccagtcggcaccgctgagccgtactgctcgatccagaagcctgacttcggcaaccctgagaagggcttcggcaaccctcgtggcgtctacaaggtctcgctgaccattccttcgcgtgaagcccagccgttgatcgacaagatcaccaaggcttacgacaagaactgggctgagatcagcgaagcgtgggagaacggcggtcgtgctgctgctcaagccaagctggcccgtggcaagaaactgctggaagcctatcagggcgagctgcctttcttcgagaacgaagatggcaccgtcacgttcaagttcagcggctatgcctcgtacaaggaccagaagactggcgagaaccgcgacatcgttctgcgtgtcgttgacgccaagggcaagcgcatcgaagccgttcctgccatcgctggcggttccaagctgaaggtccgcttctcgatcttcccgtacaccttcggtgccgttgttggtgccagcgtgaaactgcaactggacagcgtgatgctgatcgagctgcgtgagttcgctgctggtggtgacgactgggccggtcaggaagaagaaggctacgaagctgctgacgaccgcgaagaaggctggcgtggcgagcaaagcgaagaagacgaagactctaaccagtacggctcgggcgacttctgatggcttgccaactattcactggctgcctcaattcagacgggtacggcgtggtgaaagttggcggcaagacgaagctggctcaccgagttgccttcgagaaggctcatggggaaatccctgtgggcctcgtcgtcatgcactcatgtgacacacctgcctgtattaaccctgagcatctaagcgcaggaactcaacaacagaacgtgaccgacatgatcgagaagggccgcaaggcgatcctaaaggggtccagccacggcaaggcccggctttccgatgagcaggtcaaggagattttcctatcgaaactcagtgattccgctttagcaaagcagctcaacatcaacaggtcagttccttggaagataaggaagggccaactatggcgtcatcttacggagggcctcgaaacgcccgagtaggagcattccgctctggactcgaagaccgaaacgcgaagcacatggacaagctcggggtcaagtatgacttcgagaagttccacatcaactacgtggtgcctgcaagggacgctcgttacacaccagacttcatcctatccaatgggatcatcgttgagaccaagggaatctgggaagtggacgatagaaaaaagcacttgctgattcgtgagcaatacccagaccttgacattcgactggtcttctcgaactccaactcgaaaatctacaagggttcgcccacgtcctacgccgacttctgcacgaagcacggcattcaattcgctgacaagttggtccctcgtgactggctgaaggaggctcgcaaagagataccccaaggggttctcgtaccgaagaaaggaggttagtcatggccaaggttcaattcaaaccgcgtccagccacggacttcatcgtggttcactgtgcggctaccaaggccagcatggacataggcgtccgtgagattcgccagtggcacgtccagcaaggctggctcgacattggttaccacttcgtcattcgtcgtaacggcaccgtcgagaacggtcgtcctcacgatgtcatcgggtcccacgtcaagaactacaacagccgagcgctgggcatctgcctcgctggcggtatcgacgacaagggtcaaccccagaacaacttcacgcctgagcagttcgcatcgctcaagctactgctgatcgccaacaagcgtcagtacccgcaagcccagatcgttggtcatcacgacctcgactctggcaaagcctgcccttccttcaaggtctctgactggctcaagacggctggcatttaaaaaccctcactgtggctcacatggattcgttccgtgtgggcctctttgcgttgactttaggaggacattatgaaccgttccttactgcaaggcggtttcgacctctgtgagcatctcattggactgggcatcggcgcgatcatcgctggtggctgtgcccgtgacctgttcttcggggtggaaccgaaagacatcgacatcatttgcgcgggcagtgacccggagacagtttccagagcgctcgatgaaggtggttattcctacgagaagttccccaagtaccacaccgggtctgactcggatcggctgcaaggggtctggaagatcgaaggctcgaacatcgacgtgatcctctacgagaccgattgtgtctccgaggcgatccagaagttcgactacaacctcaaccagttcgccatcactggcatccaacggggcatcgaaggggcgaccattcgcttcatgggtgcgagccattggagcaaccttgtgagactccgtgaggatgctcgtgggtcgcgtgccgagaagatggaagccaagtggctggccctgatcgacaaggctccaaacgtggatgagcgggaggtggctgatgtcgtctcctgaagaaagcgaaagcgtattcctgaagcacatcccctgtgagaactgtgggtcttcagatgccaactcgcttttcagtgacggccaccagttctgctttgcctgcgaccattacgtcaagggtgatggggagtcatctggtgagcgtgtccagaaggagcgcaactctgactgcatcgagttcgccaagtcccaaggtcgattccaagacctgccagctcggttcattcaggaggctatctgccgccagtatggttactgggtcggtaaggtctggcacccgatcaagcgtgaagtggtcatggctcaagtggccaactactacgatgctcagggcaacctgacaagccagaaggtgcgggacgccaccaaggagttcttcaccgctggagcacacgacaaggacgctctgttcggtcgccagctctggtctggtggtcgcaagatcgtggtcaccgagggcgagatcgactgcctgacagtggctcagttgcagggtggcaagtatccagtggtctccattgggcacggctccaaggcagcgaagaagacctgcgccagtaactacgaatacttcgacacgttcgacgagatcatcctcatgttcgacatggatgacgctggtcgggcagcctctcaggaggccgctgaggtactcccaccgggcaaggtgaagatcgctgtccttcccttcaaggatgccaacgagtgcgtcaagcagggcaacgccaaggctgtcactgacgccatctggaatgcccagccgttcgtacccgatggggtcgtctctgcgaagtccctaaaggcccgcttgaaggagaagaaggtgatcccttcgcttcctctggtggcccctcacgaactcaagaagatgaccaaggactgccgtggtggtgaggtgatcctcgtgacctctggtagtggctcgggcaagtccaccttcgtgcgtcagaacgtctacaacctgttccacaacgagtccattccgtgtggcgttgccatgctggaggaagccgttgaggaaaccgttcaggacatcgttggcctgcacatcggtgctcgtgtccgtcagaaccctgatgagaccactgaggaagtcttcgaccgcgccttcgatgaaatcttcgagagcgacaagctgttcctgtatgacgcctttgcggaagccgctgaggatcgtctgcttgcgaagctggcctacatggtcgaggccgaaggttgccgggtgatcgtgctcgaccacatctcgattgtcgtgtctgcaatggacggcgatcaggatgagcgtaagaccatcgaccgactgatgaccaagatcaaggcatttgccaagaccaagaacgtcgcagtgttcgtgatctgtcacctaaagaaccctgacaagggcaagcctcacgaggaaggccgaccaatcgtggtcaccgatctgcgtggctcgggcggtctgcgtcaactgagcgacaccatcatcgcgctggagcgaaaccagcaaggcgcattccctcacatcatcctgttccgcgttctcaagtgccgcttcacgggcgagacgggcgtggctggattcatgcgttacgacaaagcaactggtcgcctcgaaccaatgccggaaggctggaaacccgaggacacatccgaagccgatgaggcgtggaaagaccagcaagaacccgacttttaactgaaggagaaccaccacatgaaagcactgaaatcgttcgacatcgttaccgctctgatcgttctggctggccgcatcgccaagcgtcgtcacgagaagctggtcgcccgtgaggcgtccctgaaggctgccattgcggctacccaagctgcctatcagcagaccgtctcggatcgcgtgcaggccgactggcgtcaccaagacatcacccgagtgaagtaactcaaggggtcctttcggggaccctttcggttaactcacacgccactcaataggagatacaccatgaaccattccgacatccgcaagtacctgaagcaaggcgagcaggccgtcgatgttctcaagtcgctgggctacacctacgtggccaacggcaaagagcaccctcattgggtggcccctgtgaatcctctcgacccgatcattgagggcatcaagtcgatggtctccgagcaggttgctgcgaccatcaaggaggaaacctcgaaggcatacctcaagggcgaagctgacgcgatccgcaacaccgacctgcgtggtcctcaatgggactccgtgaaggacctcaagggtctgccgttcagcatcatggtcgccaagattccgagccactcgaaactccacggctactcgatgacccacttcaccaatcggcagttctcctgccttgaggtgcgctaccaccgctcgcctgagtacaccggttatgccgtgttgttctcgttccccgtgcgtccattccaccctgagactgtctggctcccactgagcgcctgcgtcttccgtcgataggagggcaaccatgctcatctctgacatcgaaacgaacggcctccttgagaccgtcgataagttccactgcgcgaccattcaggactggttcaccggccagtacacgcgcttcaatgaggccacctttggggactacatcaaggccctcgaagctgaggctgcgaagccggatggtctcatcgtgttccacaacgggatcaagtacgacatccctgcgctggacaaactgaagcgtcaatacttcggcaagcgtctgaacatccctcgcaagaaggtgctcgacacgctggtactggtgcgactgatccactcgaacatccgtgaccgtgacgctgggcttatgcgctctggcatcctaccgggcaagatgttcgggtctcactctctggaagcgtggggctatcgcctcggtgagatgaagggtgagtacaagcacgacttcatgcgccagctcgaagcggacggtggcgtctacacgccgggtctcgaatgggctgtctgcaaccaagcgatggaggactactgcgagcaggacgttcgcgttacctcgaagctccttcggaagctcatggaggactcccactacttcgtggatggtcaagccattgagtgtgtccgtatggagcacgctgctgcatggacgctggcccagatggagcgcaacggtttcccgttcgacctcgaaggtgctgagcgactctatgcggaactcgcagggattcgccaagacctgctgaccaagctcatcaagaccttcgggtcgtggtatcagccgaaaggcggcaccgagcagttccgtcacccggtgagcgacaagccgctggagacgtggaccaatgggccgttcgctggtcaagccattcctcgtgtgaagtatccgaaggtcggtggtgtgtacaacgccaacggtaagaccaaggacaagcgcgagaccttcgctggggcaccatacaccccggtcgagttcgtaaccttcaacccaacgtcacgccctcacatcatcaagatgctcaagaaggctggctgggaaccctctgagttcaccgacaacggtgctccgaaggttgacgatgaggtactcgaacacgtccgtgtagatgacccagagaagcaggcagcgattgagctgatccgcgagtacctgatgatccagaagcgcatcggcatgttggctgaaggcgacaacgcatggatcaagctggtgggtgaagacggtgcgatgcacggttcgatcaacccgaacggcgctggtactggtcgtgcgactcacgcatacccgaacatgggtcaggtcccttctgcgagtgccacctacggtcctcactgccgtgcgctctttggggcgacccatgcgaagaagcgtaagggctgggagaaggtcgtccaagtgggcaccgatgcgagcggccttgagctgcgttgcttgggccactatggggcacccttcgacgaaggccgttacgctgacaccgtgctcaatggtgacatccactgggtcaacggcaaggctgctggcatcatcaagttcgacgagcgtgataagcacaacgaagaacatgagcgtgtccgtggcatcgccaagacgttcatctatgcgttcctctatggcgctggtgatgaactcgtgggttcctttgtggggggcggtaagaaggaaggcaaggccctgaagaaagacttcatggaaaacaccccggccatctctggcttgcagggtgcgattgccgaccagctcatcaccgagcagaagtggaaccaagcgacacgccgtttcgacatcaagtggaagcgtcgttggcttcgtggtctggacggtcgcaagattcacgtccgctcgcctcactctgcgttgaacttcctgctccagtccgctggcgcaatcatctgcaagaagtgggtcgtcgaagtcgaacgaatcctcatggaagaacatgggctttaccacggctggtacaaggacgatggcacgcccggtgacttctgctacatggcgtgggttcacgacgaactccagatcgctgcacgtacacccgagatcgctgagatcgtcgctaaggtggcccaacaggctatccgcgaagtgggtgaatctttccaattccgttgccaactcgacactgactacaagatcggtgcgacatggcgcgagtgccactaaggagacccttatgtccatcactatcaaagtcgcaatcaaccaaaccttcagcatggtcgtcgaggattcgatccttgagcagatcgctgctgagcgcgtgaaggcccgtgaggtttcccctgagaaggtggcaaccctgaccggcgagaagcgctactacatggaagtgttccgtagcgagcgcaccgatgaggaagtccttcgggtcgtcttcaaggactcgctgatcgaatgcgccaaggaggccgctggtgagatgaaccaagaaggcattcgagtgaagggccaccagaccgtggtgaccttccctgagccgaacgcaaagatcgccagcgcactggcccggtcgtgcgactgcaatgcctgctacgagtgcaagatcgccaacggtggccgggatgaatgagtacctcgtgaccctctggggactcaagaaggctgcccgtgcgtaccagagcgactttgttcgtgggcgcattgcgctggtcaatgaggcagcttgccgggggcacatctcgtgcctctcgactgccggtaagaacatgggcttctggtctctcactacgagcggccagcagttcctcgcacaatatggaggtgccctatgagcaaactgaaagtgggcctcgcccttgacatggactacctcatcttcagcgccatgagcgccagcgaagaagaagtggactggggcgaagacgtgtggacgctgaactgcgatcacaagaaagcccgtgacattctgttcggcaccctcaagaccatcaaagcggacatcgctgggcagctcaagcgcaagtacaagctggctcctgaagcctacgagttcgtcgatctgtgcatcctgtcgggcgacgacaactggcgtaaggaggtccttgagacctataaggccaaccgtaagggcaagcgcaagccagtaggctacccgcacttctaccaaggcatcatggatcacttcggtcctgagcgttcgttcaagtggcatggtgtggaaggtgacgacgtgtgtggcattctgatgaccaatccgggtctcgctggttgcgaccgggttatctcggtgagctgcgacaaggacttcaacacggtccccggttacttcttctggttgacccagatggagctggtgaagaacgacgaggcgactgccgacaagttccacatgatccagaccatgatgggcgacgttaccgatggctatggtggcattcccggtgtgggcaaggaaaccgctaaggagttcgttgagaaccctgagttcttctatcaggccaccaaggtgatgaagtccggtcctcgcaagggtgaggaagtgtcctactggacctcctgcaagagcggtgacgagcagttcgatctgttccaaggtcctgacctctgggcctgcatggcgtccctcgcagcgaagcaggggatgtctgaggaagacctcatcgtccaagctcaggttgcccgtatctgccgcgcaagcgacttcgatatggacaccatgaagccgatcctgtggcgtccacacgattcgtccctgcgccgctctgctgcctaaaaaccctcactatggccataggggaccgttaggttatctctgtggccttttcgtttaatggagggccaatgctcaaagttatccaacatcacatccaaaaccctgatgacattcctgacatcgctccagccgctgctgagtatctcgctgtacgcctgaacgcctcgtacctgattgccactggcatcgtggatgacctgcgcaaacaaggctactccgagggctacattgcgggcttccttgacggtgctaacgctgctgtcgagatcaccgagctgatgcaggaggctcagttacagaaggaggaatgaccatgtgcttcaaatccaaggtcaagaccccaaagaccaatcctgattccctgaaggcacccgagccggttctcattgaggaacccaagggtgtggacttcggggcctcggaagatgaccaatcgaccgagactgggaccgactctctgaaggtcaagaaggactccaccagcgacaagggtgacgggtctacaaccgccactgccaaggataccggcatgggcaagaccatctctgcgcctgtcaagcgggcaatgaagaaggtcaccaagtgataacccaatggcgtcaatgcggggaccgagcggtctttcgtgagcgcttgagggagatcattgagcagttccctgagatgacatggacccgttccttttatgaggcccatgcggaaatctgtgcggccactgagtcactcgatgagtgggtcgagctggtcgtgagagatgcctctgggaagctcgtggggttcgctgtagcgacggacgacgatgacagtcatgtaggtgcccttctgggcgtccagtggcgcatggtctttccagaggccccagcgggcacctgcatgaagctccaacgtggtctcattaagctggcccgtgaatgcaactacaaggtcatggcgtatacccaccgagtgggcgaaggacgctatgagatcaactacacgaaactgaaggagaaacccaatgggcaagaagatcaagaaggccgttaagtcggtcaccaagagcgtctcgaaggtcgctggcgtggcctctggtggcctgctgggtggcagcgaagacaagccgaaggaagtggtccaacaggccgctccagtggaagctcctgcacctgtagcgaacgctgctgctgtggtcgaagcgccgaaggattccagtgatggtgaggacgattccgataccgaagctgcgaagaaggctgctcgtgccaagggcaagcgtggtctgtcggtagctcgctctgccggtactggcatcaacatctgacaaggaggtgaccagtggccgagaccaaacgagaaggtctcgctgaggaaggcgcgaaagccgtttacgaacgactgaagaacgaccgagtaccttacgagacccgtgctgaaaactgcgccaaggtcaccatcccttccctgttccccaaagactccgacaacagctctactgactacacgactccgtggcaggcagtgggcgctcggggtctcaacaacctgtccgcaaaggtgatgctcgctctgttcccactgcaaagttggatgaagctgaaggtctccgagtggcaggcaaagcagctcgttagcgacccctcgcaactggctgtggtggaacaaggtctgggcatggtggagcgcatcctgatgtcctacatggaagccaacagctaccgagtgacgctctttgagttgatccgtcagttggcccttgcaggcaccgctctgatctacctaccaccacctgacgcatcgtccaattcgtataacccgatgaagctctacacgctccacaaccatgtggtccagcgtgatgccttcgggaacgtcttgcagatcgtgacgctcgacaaggtggcctatgcggcactcccagaggacgttcgcaacagcctctctggtggccaagagtacaagcccgagcaggagctggaggtctatacccacatttacatcgacgacgagtctggtgacttcctgagctatcaggagatcgaaggcgttgaggtcgatggcagtgatggtcagtaccctcaagatgccctgccgtggatcgctgtgcgctggaccaagcgagatggcgagcactacggacgttcacacgttgaggaatacctcggcgacctgaactctctggagtcactcaatgaggccatgattaagttcgccatgattagctcgaaggtcgtcggccttgtgaaccccaacgggatcactcaggttcgtcgtctggtcaaggctcagactggtgacttcgtggctggccgtaaggcagacattgagttcctgcaactggagaagaccgctgacttcactgtggccaagtccgttgctgatgccattgaggcacgcctgagctacgtcttcatgctgaactctgccgttcaacggtcgggtgagcgtgtgaccgctgaggaaatccgctacgtcgccagtgaactggaggacacccttgggggcgtctattcgattctctcgcaggagctgcaactgccaatcgtgcgagtgctgctcaaccaactgcaagcgacccagcagattccgaacctgcctcaagaagctgtcgagccgaccgtaacgactggtgctgaagcactgggccgtggtcaggacctcgataagctgacccagttcctgaacgctgtggcaaccgtgtcgcagttgaatggtgaccctgacctcaacgtgaacaacatcaagctccgactggccaacgccatcgggattgacacggcaggtctgctgctcaccgaggccgagaaggctcaagcgcaatcccaagagatgctcaagcagggtggcctcaacgctgccgctggtattggctctggggtcgctgctcaggctaccgcaagtcccgaagcaatggagtccgctatggacaccgctggggttcaaccggggccaatcgccactcaggtttaaaaccctcactatggctgcatggagacttctctgtgcggccttctttctgataactcaaggagacctcaatgtccgacatttatgccgagttcggcgtcaacggggcagtcatgtccagcaacaacatcaccgagcacgagcagaacatgctggctctgccgacctctgtccgtgatggcgatgagtccatcgagaccatcgacccagagactgaagtcgagctgggcaccgagcaggatcaggagaccgatgtcgaggtcactgacaacgaagctggcgatggtgagaacgatgctgctgaagaaggcagcgaaaccgagttcaccccactgggcgagcctgatgctgagctggtcgaatccagccgtcagatcgacgagtacgccgaaggcttcagccagatgcgcgagcaggccatcaaggctggtctcagtgccgaagtggcggaccagatcgaagcagaatacgagcgtgacaaccagctctccgaggcgtccctgaaggcgctcgaagcggtgggctacagtcgcggtttcgttcgctccttcatcaacggtcaggaagctctggcgaacacctacgtggcccagattcaggcttacgctggtggtcctgagaagttccaagcgatcctgtcgcacctcaatgcgacctctaaggacgccgtggcttctctcgaaaaggccatcgagtcgcaagacctgcacgccatcaagaccatcatcaacttgggcatggcgagccacaccaagaagttcggtaagacccctcaacgttcggtcaccaagcgtgccccagcgtccccagcggctgcccgtaagagcaccgtcgagggcttcgcttcgcaacgcgagatgatcgctgcgatgtccgataagcgttaccaagatgacgcttcctaccgtgctcaagtcgaggcccgagtgggtgcttcgagctggtaaggcactgatttaaaaaccctcactatggctgcatgagagttctttgggatgacccaaggactccgtgtgcctatcaattctgcaaaggagaactacacatggcaaacgcaactggcggtcaacaaatcggtgccaaccaaggcaagggccaatcggctgctgacaaactggctctgttcctgaaagtcttcggtggcgaagttctgaccgcattcgtgcgtcgttccgtcactatggacaaacacatggtccgtaccatccagaatggtaagtcggccagcttcccggtcatgggtcgcaccaagggctactacctcgctccgggtgagaacctcgacgacaaacgtaaggacatcaagcattccgagaaggtcattcagatcgacggcctgctgacttccgacgttctgatctacgacatcgaagatgccatgaaccactacgacgttcgtgccgagtacagcgcccaactgggtgaagctctggccatcgccgctgacggtgctgttctggctgaaatggccaagctgtgcaacctgcctgctgcgtcgaacgaaaacattgccggtctgggccaagccgttgttctgaacatcggtgctgctgctgatctggtcgatgtcgaagctcgtggtaaagcgatcctgaagggcctgactctggctcgtgctcgcctgaccaagaactacgtccctgctggtgaccgtcgcttctactgcgccccagaagactacagcgcgatcctgtccgctctgatgccgaacgctgcgaactacgctgcgctgatcgacccagaaaccggcaacatccgcaacgtcatgggcttcgaggttatcgaagttcctcacctgaccgtgggtggcgctggcgacaacaacccagccgatggcgtggctccgaccaaccagaagcacatcttcccggctaccgccactggcgatgaccgtgttgcccagaacaacgtggtcggcctgttcaaccaccgttcggctgtcggcaccgtcaagctgaaagacatggctctggagcgcgctcgtcgccctgagttccaagctgaccagatcatcggcaagtacgcgatgggtcacggcggtctgcgtcctgaagctgctggtgcgctggtcttcaccccagccgcctaacggcaacccaaaccccttgaggcccttacggctttgaggggttttttcattaggaggatcaacatgcgctcttacgaagcaacactcgaaacagatgacgaactcgcagccatcaacgacatgctcgcagcaatcggtgagtcccctgtgagttcccttgagggggaccctaacgctgacgtggcgaacgctcgccgcatcctcaaccaagtcaaccgcgaagttcaatcgcgtggctggacgttcaacattgaggaaggcgcagtgctctccccggactccttcagtggactcattgagtacctctcggactaccttcggatcaccacctcgggtggcaccgtttacgtcaaccgtggcggttacgtctatgaccgctcgaccaagaccgacgtttacaccaacgacatcacggtcgatctgatccgcttcaagaccttctctgagatgcctgagtgcttccgctcgtacatcgtggcgaaggcttctcgacgattcaacatccgcttcttcggcgctggtgagatcgaagggtctctgcaagagcaggagtcggaagcgtggcagcagtgccaagagtacgaactggactacggcggtttcaacatgatcgacggtgactcttacgtcggtggcatcgcatctcgataaggagggcctatgggactcgtttcgcaatccgtcaagaacctcaaaggaggtatctcgcaacaaccagacatccttcggttctccaaccaaggcgctctgcaaatcaacgggtggtcctcggagactcaaggacttcagaagcgaccaccaaccaccttcaccaagcgactccagaacaagggtttcctcggcaccaagccgctggttcacctcatcaaccgggacgcccaagagcaatactttgtgggcttctctgggaccggtctggcagtctgggacctgaagggaaacaactacaccgtgcgtggctacaacggttacgccaactgtgccaaccctcggactgacctgcgcctcatcactgtggccgactacaccttcgtggtgaaccggaacaccgtgtgccagatgggatcgaccctgaccaacccttcgtacccacggctggacggtcgagcgatcatcaacgtgcgtggtggtcagtacggtcgaaccctgtcgatcacaatcaacggtgacggcactgggtccagtcctcaagcgtccattaagatgcccaacgggtctgccgagaaggtgcccgctggtgacccatacgctggcatgaaccaagtggacatgacagatgcctcatggatcgccgctgagctggcccgtcaactgacggtggctctgggaggctctgggtggtctttccaagcgggcaccgggtggattctcatcaatgcccctgccaacgacaacatccgccagatcgcaaccaaggacggctacgctgacaccctgctcagtgggttcatctatcaggtccagaccttcacgaagctccctgcgaacgccccaccgggttacctcgtggagatcactggtgagtctgcccgttcgggtgacaactactgggtccaatatgacgcctctgggaaggtctggaaggagacagcgaagcccaagatcatcgcagggttcaacaacgcaacgctcccacacgcgctcgtgagggccgctgacgggcagttcgactggactcccctgacgtgggatggacgcaacgctggtgacgatgacacgaacccaatgccgtccttcgtaggctctgcgatcaacgacgtgttcttcttcaggaaccgcttgggtttcctctcgggtgagaacgtcatcatgtctcgcacctcgaagtatttcaatttcttcccgagcagcgtggcgaccctgagcgatgacgacccaatcgacgtggctatctcgcacaaccgtatctcgatcctgaagtacgctgtgccgttctctgagcagctcctgctgtggtccgaccaagctcagttcgttctatcgagcaacggcatcctgtcgagcaagaccatcgagctggacctgaccactgagttcgacgtgagtgatggtgcccgtccctatgggattggtcgcggggtttacttcgcagctccacgggcctccttcacgtccctcaaacggtactacgcgattcaggatgtctctgacgtgaagtccgctgaggatgtctctgcgcacgttccgagctacatcacgaacaccgtccacgcgatccacgggtctggtactgaaaactttgtgagcatcctttcggacggctcgccaaacaaggtcttcatctacaagttcctgtacctcgacgagattctccagcagcagtccttcagtcactgggagttcggtgatgcggccacaacccgtgtcctcgcagcctcgtgcattggctcctactgctacctgatgatcgaccgcccagagggcctgtgccttgagcgtatggagttcacgcaacacaccatcgactattccatcgagccttaccggacctacatggacatgaagaagaccatcgtcctcggtgcctacaacatcgacacgaacctgacttcgttcgacgttcggactgcctatggtggaacgccgggtcctgagtccacgttctacaccatcgaccagcaaggggttctcatcgaacacgaggcgcgggactgggcgaccaatccgtacatctcgttcgtgggcaaccgggctggtgagcagatggtgatcggcaagcagtacatcttccagtacgagttcagcaagttcctcatcaagcagaccgctgacgatgggtccacctcaaccgaggacattggacgcttgcagcttcgtcgtgcgtggctgaactacgaggaatctggtgccttcgagatcaacgtcaacaatggctccagcgagttcgtctacgtgatgactggtggtcgcctcgggattcaacgagtcctcggtgagttgtccgtgggtactggtcagttcaagttccctgtgaccggcaatgccgtcaaccaacgagtcaccatcaccagctccaacccgaacccactcaacgtgatcggatgcggctgggaaggtaactacatccgccgttcttccggcatctaacagtgaccaagtgggggcctcaaaaaccctcactatggcaccctatgagggtttctttatgatcttgacacaagcaaccaagcgtgaccttgaggaagcagcaggcaatctttcgttcgctgatcttcaagaattccattcccacactcgtgggcgcgatccatccgagacacttcctgcctgccttgacgagaccacgatggtcatcaaggtgggcgctttggttctggccgttggtggctccaagaattgcctgtggttcgtgacgaccaatgtggtccagtcgctgaccaagggacaacggatgcgcttctacaagctcctgcatgggcacctcaagggtctccgtgacagtgggcaccaatacctgaccaacttcgtgtcggtcgataactgggaccatatccgccttctcaactcactcggggctgtcttcgctaaggagcacaccatgagtccagccggatgtcggttccgtcaattctggctataggaggtgagctatgtgcgaaccagtatccatcggcatggccgctgtcgccctcgtgggtggcactatggctgcgcacgataagtcgaaggctgagggtgccgctgaggacgcccaacgtcgatctgcccgtgagcaggtcaagcagatgaacatggccaacgccaacctgaacctcaacgctcaggacaaggcagacgaggcccgtaagcagctcgctgaggtcaacatgcaggccctgcgaaaccaagggaccatccgcaccgccatcggtgagtcgggtctctcagggaactccatgaggcgcattgcgacctccgtcgagaacgaagcgagccagcagcgcatgtccatcactgacaactaccaccgcgactaccagtcgatctttgcgaaccagattgccaacaccgagaacaccaagagcgccctcaagggtcaagcgcaggtcatcaagacctcgggcctgtcgaacgctttgggcatcatctcggcgggtgccaatgggtacgtccaagggtcgaacctttcgagtgccatgaagggtagctcggcaggcggttccaacggcacaccagcaggaggtaagacctaatggcaaacgatatttccagagcggtagatcagtcccgcttcggtggcactgagcggctccacgggtccactgcgaccactcagttccaagcatccatccaacgggcacctgtgggttccacgggtctcgctgaggccatgcagcagttcgttaagtcgggcagtgcagccttcgggacgtacaccgagcagcgccaaaagacagccgatgagaggtccaatgagatcatccgaaagctgacccctgagcagcgccgtgaggcaatcgccaacggcaccttgctgtatcaggatgacccgtatgcgatgaacatgctgcgtcagaagtcgggtcgctctgcggcatacgatgtcgaggatgaaatccagaccaagctcaacaatggtgagttcgatgggaaggaccgtaagtacctcgaagaataccgccaacaacgcttggcccagtctgcgaagtcatatgcggaatctgctggcatcgacgagaacgaccctgagtaccaagcggggttcaactcggacatcgttcagcggaacgcgggtatctatgacctgcacgctcgtcgtcgctctgcgtggtttcagtctcaacaggctgtgaacacccgtggcgatctggctccgttgctggacgaccccaatgtgatgcactcgccttcgggcggtgaggtcatctcgggctacttcaataacggcttgcagaatggttccttccccagcgacaagcaggccattgattccctctcgatgctcgttaaggacgtgcagcagaaggacggtggcaccaacctgcttcgctccctgcgagaccagaccatcaacgttctgggcggtcccaagaaggtctctgacctgatcgacccggacatctacgagaacgccatcgcgcaatccgaggcgaacgagtacaagcgctatcagagccgcacccgtgagtttgagctgggcatcactacggccatcaatcaggagaaccctgagaccggctggcggatgctccaagacctgcgggcgaagaatggctggctccaagggtcggacaacatgacccctcagaagcagaagttgattgacgctgagcagcaaatgatcggcatggttcgccagcaatcccaagcgaccgccaaggagacccaaaaggccatccaaggggacgctcgtgttggatacctgaagcagcagtatgaggctcgaatcagcggccagaacgtgtctgtcgatcccaagttccaaccggacatcggtgcgggcgagtggaaaggcgtggacgcaatgaccgctgccaacgagatcatggccgacatcaccaagtcgaatctccctgacaacgtgaaggacgccaagcgtgctgcatacctgcgtgctgactatcagggcggtccattccagacctactaccaagcgctcatcactgacgcccagcgggaatggaacaactcggtgcgctctggcgagccgggtgacatgactcgaatcactgagctgcaacgtgcctatgcggctgacccagcgaccatcggttcggtctacccagagcaggctgacttcctcgaaaagatgaaggacatggctgactcaggggctgacccgagcgtgttgattgccgctgagaaggccaccaagaacatgagcatcgacgagcgcaagttccgtgaccaagcgtgggcagacctgaagaacgattccagcgccaaggacctgacctctctaccgggtccccttgagcggatcgctcggactctctacgacggttacaacgagcgcactggcaacgccaagcaggcccaacagaaggtctctgagtggctccagaagaacaccgttgcgttcaccgaagatcaaggagggacattctccagtccagaccaaggaacgctccgtggccgtctctcgaagaaagcccttatggctgacccagcagacgtgaactcgtggcagggcggtcagagcatcgtcgaggacaccttgaagggcctcgctgagaaccctcaatgggccgacaccgggatgaccgtggaaggcaccgactctggggacatcgttatcagctcgctcaacggcaagcgggtacgcattacccagcagcagatgcaattgatctacaaggctcgccaagcagcagcggctgagcagaagttcaacgagaagaaggaatcggtgaagaccggccagcttctctacaacgacgtaatccgagggggccgtggccctctctaacaggaggtctacatgaaccgcaaagacgaatacgccaagctggtagcagaaggcaccccatacgacgacgcaattcgtcaggcagcagatgccaatggggtcccctacgagtacctgcacaagaagattttcatcgagtccagcttcaaccctgacgccaagtcaccaaccggacctctgggtctggggcagttcaccaaggcgaccggcaaggcttacggtctgatgaccgatgaggatcgtctggacccaatcaagtccatcaacgcttccgctcagtacacccgtgacctcatgggcacctacaagggcgacatgctgaaggtggcattggcctacaaccaaggcaatggtcgtctgggtgctccccagttggccgcgctggatcgtggggacttctccaagatcagccacgaaggtgcccagtacatggccaacctgctggacgtggcgggcgactctccgaaccgtaagtggttcgatgggaatccacaagccccaaagctcaactctgacttcgagcaaaacaccaacggggtcagacaccagccaaagggtgtgccggaacttcccgagtcgcagggcttcaaccttgccctcggggatgctcctaaagtccaaccaacgttccgcgagatggagatcgaccagaacggtccagagaagggcgcatgggacaacacatgggatgccgttaagtcgtccctattgaccagcgtcccggctcagatcgctcggaacataaccgtcgaggaccatgacccgttggactgggtgaagcccggtgacacctcgaactggaacgatcaggacttcgagaacatccgcaaggaagggatcgacccgcaatacttcggcttcatcttcgactacaccaagggcagccgtgacaagctcccagaggcaatcgccttggcgaaggaaaacgctgactatgatcgccggatcggcaaggctggctgggctggtcaactgaccgctggcgtggctggtgctgctctggacccactgacctacgttcctgtgcccggtggtgctggtgcctcattcgctgcccgtgtgggtaagcaggctgccttcagttcggccatgtcggtcggctctgaggctctgcgtgagcaggccactggtatcgaaggacactatgcggctgctgctgtaggtggtgccgtgatcggtggtgcggctgctgctgctctggacaagttcattgccaaggctgctgtctctggtcgtaccgatatggccgatgccgacgtggaagctgtgctggctcgccacggcgaagctggcctacctaaccgtgacgttgagttgcctgaaggtatggcaccagtccagcgcaagccggaagatggtgagatggacgatgactatctggagaagattctgggtctccacggtgagcgcagccacaagcaggaaggcttcaagacaatggccgacgattccgttgagtccatccttgcgcgacacgctgagtcgtctgagccaaacgagttctatggcccgaccagtcgcctgcaagcccgtgaggctgctcgccaagctggtgtagatgatccaacccgtatgccgatcaactccgatgacgcccttgaggacttcaatggggtgctctatgcggacaaccccggcgagcgtggttcggttcgtctgcgggatggctcgatcctgtctggtagcaacccgctcaatccgaagaccaacaagttggccgctgagatcggtcctgaccgttccgctaaagggttctcccttggggcgatcactgagatcggctacaagctgaatcgctctgaggaccctgacgtgctggacatcggctcgaaactgttccgttccacggtgcagactgagagtggctccaatggacgctttgcggctaccgcttcggacatcattgagcgccttcgtggtgaggacaacctgtcttatgggaagctcaacgacctcactgagagcctcctgaagaacgacccgaagtatgccggtatggatggttcgaggctggccctgatggagcgagcgtatcgtcgcgtggcggaagctatcgaggactcaacgaacgccaagaaggccatgctgagcaagcaggagaaggagctgatggaccacatcaacgagcacttcacccgcaagcaggacgtgttggaaaaccctgcccagttcggcaatgctcaggcgaccgctgtgctggaccagagccgacacgctggccactatgtgcctaacgtctatgacgatgctgcccgtgcgctgtacctgaagaagttcggtggtgctgatggtctccagcaggcaatcaagtcgagctggctggcgtcctacgcttcccgcgctgctgtcaaggctcgggtggacaagttcatcaaggaagcaatcgagaaggaaggcaaggtggcaacgcctgagctgattgcccagcgtgtcgagcgctacgcccatgacaaggcatacggcatctcacacactcaggacttcaaccgttcggcactgatcgacgatggtcttgattcgctggtgggcgctgagaacaacaacttcctcgaagctcgtaacctgttcgactcggacgtttcggtgccactgagcgatggttcgtcgttctcggtcaatgacctgcgcatgtatgacttcaccaagctgatgccatcctatgaccgccgtatcaacggtgacgtgggtatcatggctgcgactggtgagggcaccgatgcgctcaaggctcgtgtcctgaagatcaagaccaccaagggcaacagctctgacgtggaggcccttgagtctgccgttaagctactcactggtcgcgctcgtcgtgacccagatgatgcctttgggactgctctgcgatccctcaacgacctgtccttcttcaccaagaacgcctacatgggcgtgcagaacttcaccgagatcgccgggatggtgaccaatgggcatcttcggatgctgatgcacggtgtgccttacctgcgtgagatgactacttggggaaccaagatcaaaccagagcagctcaaggagatgcacaacctgatcttcgggcgtgaactggatgacaccatccggcctcgtcgggctgacatcgtggaccgtctgcggactcaaggctcgaacaacttcgttgcccagaccgtaggctctgccaagttcgccactcaggaactggccgctcgcagtccgttcaccaagctgctcaccgagacttccaactacatcgctgacgctggccgtcaaggtgctctgatggacatgatccgagctgctcatggggacactccgagaatcctcactgacaaggagctgcatcgcctgtcgatcaccaagcaacagttcggtgacatcaagcaagcgatcaaggagcacatcgtccctgacggtgatggcttcaagatcaaggacccggctgctctgcgcagtgacccacggacaatggatatgtggcggatcggtgacaagatcgccgacgagtcaatcctgcgtccacacaagctgtcctctcaggactcccgtgctctgggtgctggctggcatatggcgctccagttcaagaagttcgtcttccggtccctcaacggtcgcctcatgcgtggcatctacgactccaccaagaatggccgaggcatcgacttcgctattcaaggggtcgtcgcaacgggcctcgcaacgggcttcttcgtggcgcaacgctacgtgcaggctcagggtatgccgccagagcaacgcaaggacttcctcaagaactccttcacaccagagatgctgggctgggcagcgatgtcccgtaacaacatcctcggtgctccaatcggcgtggccaacttcgtgctcgctccactgggttacgacccggctgctgctgtgcgtacctcggtcctcccaagaggccctgagttcgtcgctaaggatcgtccagtacgttactcgcctctccgttcggatggcgttcagcgtccactgagcggccttctggagcaggttccgggtgccggtatcctcggttcggtctaccaagtaggtgcgaactctgagggtctctggaaggacactcgccgctcccaagagctgggctatatgaccggcatttacaatggactgcgtggcctcgtgccaaacgatccagtctcgcaacgtgctcttagcgccatgatgcaggaagcaggtatggaataccgcacccgctaaaacccctcactatggcaccctcaaaggctcacttcggtgggccatttttttaaaggagacgatatggctactacaccaaagacggtgcggacctacgctctcgacggcaccaagaaagacttcacgatccccttcgagtatctcgctcggaagttcgttgtggtcaccttgatcggtgcaactcgacgtgagctgatcctgaacaccgagtaccgcttcaccaccaacacgaccatcaccacgaccaaggcatggggaccggctgacaacttcgacctgatcgagattcgccgactgacctctgcaactgagcgtctggtggacttcgctgatggttcgatccttcgggcctacgacctgaacatctcgcaggttcaatctctgcacatcgctgaggaagcccgtgacctgaccgctgacacaatcggcgtgaacaacgatggtgacctcgacgcccgtgcccgtaagatcgtcaacctcgccgatggcgtgaacgatggtgatgccgtaaacatgcgtcaacagcggcaatgggcaggctctgcgttgaactctgcgaacgccagtgctgcctctgcgcaagcctctgaggcgtcccgtcaggcttccttggcgcaggcccaagcgagcgctgcaagtgctggtcaatcgagcacctatgcgaccaactctcagaactctgcaagcaactctcagacttcccgtctggcctctgaggctgcccgtgacgcttccatcaccgcccgtgatttgtcccaagcgtgggcctcgaaggctgaggatcaggtcgttgcatctggtctctattcgtcctaccactacagccgtaagtcggcagcaagtgcatcggcgagtctgacctctgcgaacaactctgcgaactctgcgagtttctctacgaccgaggccaaccgggcaaccactcaggccgaccgtgcgaagaccgaggctgacaagctgggcaacatgaacgcgctcggtggggcgatccgtgaagtaaacacgactggcaagaaggtagagatcaacaccggctgggagtggaattctgacgtaattgcggtagacgggttccgctcaaggagttcgtcctccatcgacttcaatgcccagctcaacgggagacttggcgcttcattcactgggagcctttcagttggaggtactaccagcctacagaacaccactgtagccggtctaacagtgaactctggtgcccagttcaagaatggtaacgtgcaggtatttgccccgaactcatcgtctaactcccatgtctggttctacggccctgacggtacttcccgaggaattctctatgctggcacagacaaagcggtaagggtgcaagcaggggaggtagtgtgcgcgaccttctctccagatggagggaccacactaaacaacatatctgctggtaatgttacggcccgtgctactgcatatactcaaggtgggattgagaataacgggcgtgtcgcgtcctaccgcaatggtgtgggcgcaaatgcttccatgtatgccaactgccacttcatggctcagaccgacgatggcactgccccagcctatgggttccaccgtggtggctcgtatgctctggctctttggctgaacggaaatcagttgcacatgatggactcaagtggcactaaccgagaaatcctgaacaacacgaacttaggctcttggatggtcagcgtaggggagcagggtgtcggctcgtatgcgttctgccgttccggcgtgactgctacctacggcgttgacgttgctggtggaaacctgacctacggctcgactggcgcgaacggtggctctgtccccggaacttggcgttcccgtggctgggctggaggtggtaaccataccctgttccagcgtatcgcttaacaaccaataggcccttcggggcctctctaaggagggcacatggaatttcctatcaagctcgaaacaggggtgaccctgactgccgcaaaggaccccgtatggggcgaccgtgatggcacgttcatcaactgcgtggtgactcttgaaggcggtcctttcgaggaacctactgaagttccgttcaccgcaacaccgacagactacatggcccatggccgcgacctgttcgattactttaaggactctgcgggaccgtgggttcgcccagatgtcaccatcgaagacttacaagctgacttcgacaaaatctggcccgacgtgatgttgggtctggccgatcaggcaaccatcgacctcgctaagaatctgcgcgttcagatcaaggcgatgagctgatggctggccttgagatcgacttcaccaacggggtggttcgcgctgcccctatcgccgctggagctggtgctgaagtagcaagccaagtggcaggcatgagcctgagcgattggttctacgccaccatcatcctctacaccatcgtgcaaacgttcgtgctggtcttcaagaccgtcatggacgagaagcgcaagaacaaaggagacccaccatgagtgacaacgttctggaaaagctgctggaggcaatcgacaccgagaccggtcgtgccctcctgagcgaccttcgtgatgacgaccgtcgttcccctcaactgtacaacgccatcggcaagtaccttgagcgtcacaagttcaccatcgccaagctgaagcccgatgagtcccttctgggcgatctggccgctgccctcaacgagttccctgagatgggtgaggatgagctgtacggtgacggagtgcgccactaatgggcctcaaggagatcgcactggcagtcgttctggctgctggtgccctcggtctggcctacacaaaaggtcacgccgatgcgaccgacacactgaccatcaaacaccaagcggaactactggccgctaacagacaactggaggttgaacgtgaacaagctcaacaaaccatcgcggccatctcaaaggaatggcaaggctatctcggttcgagcaaggcatctgctgatcgcgttgtggctgatcttcgcagtcgcaatatcgggctgtcagtccaactcgcagatgcgaccgtccggtgcgtcacaagcgacggtagacccctccctgatggtcgagccgaactacgaagcgactttgcttcagctcttatcgagcaagcccaacgagcagacgcccaagtgaagggccttcagaaaaccgtaagagcactgcaaggaggtaagtaatgtcgaaaccccgcaatggggccgacgatctggagctgattaaaaggtcattcgtggcctttctttttgtcctgtggagggcactgaacctacccaaaccgactaaatgccagatcgacatggccaagaaactgagcgccggtgacgagcgccgttttattcttcaagcattccgaggtatcgggaagtccttcatcacctgcgccttcgtggtgtggaagctgtggaacaacccagacctcaaatttatgatcgtgtccgcttccaaggaacgggcagacgccaacagcgtgttcatcaagcgcatcatcgaccttctcccattccttcacgagctgaagccggggccgggtcaacgtgacagctctctcgccttcgacgtgggtcctgccaaacccgaccactcaccctctgtgaagtctgtaggtatcaccggtcagttgactggtagccgtgctgacatcctcattgcggacgacgttgaggttcccaacaactctgccactcagaccgcccgagatcacctcggagagctggtgaaggagttcgatgcgatcctgaagccgggtggtacgatcatctatctgggcacccctcagaccgagatgaccctctaccgcgagctggaaggccgtggatacgtcacaacgatctggcctgcgagataccctaaagaccaagctgactgggactcctacgggccacggctggctcctatgctggctgctgagctacaggcagatggttccctgttctgggcaccgactgacgaggttcgcttcgatgacaaggacctgcgtgagcgggaactgtcctacggcaagggtggcttcgcacttcagttcatgctcaacccgaacctctccgacatggagaagtaccctctcaagctgcgtgacttcatcgtagggacgtttgctcaggacaaggggccaaccacccttatctggatgccaaacgctgccaacgagtgcaagggcgttcctgtggtgggtctgaagggcgaccgcttccaccgctacgaatccgttggccaagccactgcgagctacgctcagaaaatccttgtgatcgacccctcgggccgtggtaaggatgagactggctacgctgtgctgtaccaactcaacggctacatcttcctgatggacgctggtggtttccgtggtggctacgaggacactgttctccaagctctggccaacatcgccaagattcacaaggtcaatgagatcgtcgttgagggcaacttcggtgatggtatgtacatcaagctgctggcccctgtggtcaccgctacgttcccttgtgcgatcactgaggttaagtccaagggtcagaaggaactgcgcatctgcgacgttctggagcctgtactgggcagccacaagctggtcatccaagagagcctcattgagaaggactaccggacagctctcaacgctgacggcaccactgacacgtcctacagcctcctgtaccagctcactcggatcacccgtgagagagggtcactggctcacgatgaccgtctcgatgccctcgccattggcgttcagttcttcactgaggcactggagcgggactcgaaggtaggtgagtcggagatgctgcaagagttccttgagagccacatggaggacgccctgatgggtcacgaccggttgctggagatgtcgatcagcgaaggtgtgtcgatccagtacgaggacgatggctcaatgaccaattacatgggctggtaaggactctgcaagatcgcagcaagatcgacgaagatttaaaaaccctcactatggcccagagagggggtttatctcatagataaacttagagactctgcacgatccctacaaggtaggttcttcgtgcagtgcttctccctcgaccaattcaacagtgattatcaacaaaggaggtaaggccatgaccgtggagagagcgactgtgctgctcgtcttaaagcgccttgccctctctcggtccacctacaagctcatcggccttctgctcgtcaccttcggggtagcaagcggtagcgatgttatgagctgggtctccaccatcgtgtgtgtggcctctggcggatgcggtgactgacgctcaatttcggcagggttaacaccctacctcattgagccataagagcaaggcttaacgtttccctaactggtctccataggatgccctttagggtatcgttaggtctacccgatagatggcacttgcatgaaccgttgggttaccataggatgacctttaagaatctgacagaaaaatctgaaaggtcacctctcaaggacaacagccgagagttcccccgtaggggcctctcaaggatgatccataggatgacctccccggtgacctctgagtgagatcgcctcggttccctcaagggcatctcatggggatcattatgtgccagctcagag

SEQ ID NO: 22 - DNA, 40917 bp, unidentified
  misc_feature 1..11: note = bacteriophages nucleic acid sequence
  source 1..40917: mol_type = genomic DNA
agaaaaatctgagagagcacctttcagtgactaaagcggccagtacccccgtagggcctctttcagctcactcaagggactacctaccccttggcctttcaggactctctgagggatcattgagggaatctatggggttctacatggtgactctccgattgctggtgtggtgatcattatgagggcctttgagagggacgtcaagaactctttcagtgtacacttgtgctctcatctgtctctatctgtaaggacatctcaaggaacctcattaggttgaccagacacgcctatcataaggaccactcaagggttgacataaggaccatcataaggcacgggcgtacacgcggtcattaagagccgctaagcgatggtgacgtgaactaatcaatgaaaataactgttgacagcatcactcaagtctatacaatgggccacatcaacaagggaaagcgctacggcctaacctgagttgccttgaagttagtagcttctgacatgcgatcccaagggtgccaagtgtcgttaaggaagtcgaaagcaacaagggcaaacaaaacgcttgacaaactgattcaacgctgtagaatacgccacatcaacaacgaaacacgcttcacaccgctctttaacaacttagatgattcatggtctacaaggctccgaaaggacacctgtaggcatcgctacaaggcaagctctgagccttcctttagcctcttgcaggacccgaacagagttcatgggtacggtcttgcagggcgctaagggaacaactcaacggagcaacacacatgcttaaagcaactggccttgaccacgatgtaacccttgacaaagagcaagacggaacctttaaggtgacgtatggcctgcatgtgtccattgaggacacctttgaggaggctctcgcagagttcaatagctgcgtgctgcattccgcaacttgtgcaggtctgatggactgagggcatcaccatggcacgtaagctcatcgctaagcactcgaacagcctcacactggcaagcgccaaggtctatcgggatgctgagtggaatgaatatgtcgtcaccttctacaggaacggcgagaaacaacacggcgcggattatcacactgatgatcgcaaggacgccgacaagactgctgcatcgtttgtaaccactatcgaatcctaaggggatcactatgaaaggctctaaattcctgctgtccgctgttgctgctaaactggtcgctgcatacactcagtgcatcgctgagtatcgtcaagtcatgccactggcgacaggcatctccaatgatgcgccggacaccttcgagaagctcaaggctgaggctgctaaaggccgtctggtagtaaccactgagttctccgacacggctatctacgggatctctggtaacgtgacgttccgtgtgttccacgactacggccacctgctgtacaacaaggagttcacgactgccgatgagatggacttggcagcaactcagtggcgcgatctggtcaagtacattgagccagaatggcaaggcatctgccgtgtggtgtacttcgctgacacctacgaacagtcgttcttcgagagcatccatgggaagttccctgaggatcagcgccggttcgtgctgggtcacttgaacgcttggctggatggtctggtggagttgaactgatgcagggttatggtcgcttcctaacgtgccggtcctgtctctacgggcctgctacggccaacgcttgggctcgcttgtttaactgcaagtgcatcaacctcaagatgccaaacgagctgtaaggcaactcaaagggctcctaacggggctctttcggtggcactatcgcctctatcgcaaggagattcacaatgtccaacctcactatcgccctcatcgttatcgctgtttacgctgtactgtgctcggttgcaatggcagtcgcttggtacggcttgaaggatgagccagcgatctacttgaccaaagaaggctggcaccgcaacggcttcaaggagcgcagcacctttgagaacatcttgaaggtgctctttgcggtctttccactgacactgagccttatccgctcgctctggcagtacgctgcaatgatcgccattgtggtgttcttgctgggtcaactgacaggctgcgctgttaacgtggtggtcatgccagatgcaaccattcagtatggttcggccatcgaccagcacgtcgatcagagccaagtaacacaagggcagtaagtcaagtcggtggccttccaatcgagggccatccgctggaacatcaaccctatgaggcatcattatgcaacactacaaccgcactaacttcacctcaacgagtgtcgctaagcagctcatcgcggcggtcaaagaggtgctcattcagggccactcggcctaccttgcgaaccgtcaaggcaagcgctggatgcgtgccagtgtccacggtgagaacttccaagggacgttccacaagcaaacctttgagttctacgctgggtctggtcaagacgttggcgagttgatctttcaggcgtcctttgagtggccccacgagctgcaagatgagttctttcagttgctcggtgagctgagccgcttgacggaccacctgcacaacgtggtggctaagcgtgtcgctgaggctaaagccaaggctgacaaggaagcacgggacaacaaggccgctgagctgtacatcctcaagcaggccggtgcgactcacaagggcactgacagcctcggtaagacggtctacctgagctacaagaaaggttggttcgggtttggtaagaccatcacacggatctacaaggtcgagccgggtcttttcggtggcttgcaggtcagcagccaagaagttaacggtgaggctttcaccatgggaggtttcttgtgagtcaagttcacgtattgaaccaaatgacactgggcattccctcggccaacaagtactcggcatggctgcgcacgcacctgagcttggtcaaggagatggctgagtacagcgaggatgtcgagcctatcactggcaagatgtatggaccggccagcgcatgggctcgtgtcttcaagggcatcacgcagcacggtcccggcgtctactctttcccgtacctcaacccggctttctgtgaggctctcttgcttgaactggggggcttggactacacggtcaatgaggaggagccagtagaggcgcaaatccctgaggtggtcttacaggagctttgcccggtgctttacgaagtcttccgggccttctggtttgacgctgcgatcccgctgagcaagctgctgtttggccttgtgcctgacaagctgacaacggtgcaggccgctaagtacacccttgagaacacctcacggggccactggcacaccgatcaggactcagacgttactctggtagtggcgctgagcaatgaccatgagggaggcggaacagaggtctaccaagggcctttccgtgacaccatcgtggtccctcagttgcctgtagggcacgctatgttcttcaacggcaaggccaaccaacactacggcctgccagtcacacaaggcgagcggaacttgctcgtacactggagcgaaaccaaatgacacaccgcaacttccagccccgcaagccgggtctgatcgacaagcaaatccaagcagccaagaacctgcgccacttcgcaacctatgaggctcgccctgaggtgaagcgcgatgtcatggtgggcctgtatggtggtcgcccactgacttcgaccggcgcaatgctcctcaaggagatccatgtggaagcgcgagccgttgcccagtcgttcaacctgcgttatagcgatcaaggcgacttcactggcgtctaccgtggagggttctactgatggacgtgtctctcatcaagttcaaggcgtatgtcccggtccctgagagcaactttgggccagcgctcaaggagatcgagttcaagctcggccttgggccttgtggccgctacgtcgatcatctcgaaagtcaaatcgactatcacggtgtgactatcacgcagaccagctacccagaagactgggcgcatgtcaataagacagcgctcacgatgttgcagaactggcgcactactgatcgcctgatccatggtcgcggctaccctgagcagaaaggttatggctacggtaacgtcgcggcgatgactcctaccaaggaggagcaccagcgcaacaaagaagccatgcacgccatggggcgcagggccaccgagttgcaggaacaacgcgagatcaagacgtttttctacaagttagaagacgttcacggcaggatcttagcaatcaagaagtagtctcaagggcgggagtttaaaaaccctcactgaggctacagactcaaggatctctcttaggttactcttagagttaatctttatctttatctctcagttaaaagctcttaaaggaatcttaatgggcatcgaagcattcaaaccagcggcgcacgacttcaccgacatcaaggagtcttcatgggcctttgagaagctctctgcgatctacggaccagagcttgcagctactcagttgtcgttggaacacgaggcgtacacgctgggcgaggaacgtttcctcaagggtcttgagcgtcaagctgagcgcggtgagttctcgaacaacaccacggccaagcctatccttgagaccattgtgcctcagttgtccgctgcgcttaccgcgtggtgtgaccatcaagtgaacaaggttcgtcgcaagaaccctgctctgaaatactttctggagatcaaccatgacgtggcagcagcagttacagtacggtggacgctcaatcgcattgcacaacgcagtggcgcgcctacagttacagaacttgcctgctccattggcggcgcgattgaggaagaagctcgctacggtcggattcgagaccaagaacgagcccactacgacaagcacattcgcaaggccctgaaccaacgcaacgggatgacctacaaaaaggcattcatggctcaggtcgaagcgcacatgcttgaagctggtgaactcaacgcagcttgggaggagtgggacgcggcagacggtgacatccggtatcacgctggcattcgcatgctggagatgctgatcgaagtgtcccaactgatcgaagtcaagcgggagcacgctggcaacaagaaacttgacggtgagtacatttacctcaagccggaatgggccgacaagctggcatctcgtgcctacctactcggtggtgtcaaccctcggtatcaaccgatggtggtgcagcctcgaccatggaccgggatcatcggtggcggctactgggcaaagggtcgcaagcctctaagcctgatccgagtgtcctctaagcgggctctacgccgttacaaagaggtgttcatgcctgaggtctatgacgcggttaacatcgctcagaactccgcatgggcagtcaacaagcaggtcttatcggtagccaatgaggtgatgggatggaagcacgttccaatctctgagttccctttggccgaacgtgaagaactccctgcgaagccggaaggcatggacgactccgaggagttgctcaaggcgtggaagaaggaggccagtggggtctatcgcagagacgccgcaaggatctctcgccggatgtcctacgagttcactctcgaccaagccaacaagttcgcagggttcgaggcgatctacttcccgtataacatggactggcgtggccgggtctatgcgatcccttcgttcaaccctcagggcaacgacatgaccaaggggctcttgcaggctgctcaaggagaacctgtagggcttgaaggaatcgaatggctcaagattcacggggccaacacggcgggtgtcgataaggtcccgttcaaccaacgcaaacaatgggtactcgacaatgaagaactcatcttggacattgcccgcaatcccctcaacaacaccgagtggatgcaaatggacagtcccttctgcttccttgctttttgcttcgagtgggctggggttaaagctaatggcgctctacacgttagtgcccttcccattgcgttcgacggtagctgttcgggaatccaacacttttccgcgatgctacgagatgaacgtggcgggcgtgcagtcaacctgcttccctctaccgaagtgcaagacatctacaagctggtggcagatgccgttaacgagcagctccgcaaagacttcgcctctggaactgatgacggctgcaagatcatcactgacgacaagtctggggaggttctggagaaacgagagcttggaaccaagggaatggcagcagcttggcttgagtacggtgtcacacggtcggtcacgaaacgatccgtaatgacgctggcctatgggtcgaaggcttacggcttcacggaccaagtgcgagacgacacggttcaacctgcaatcgacagcggcaaaggccacatgttcaaggacgcgcagcaagttagccgttacatggctggcctgatctgggacgccgtgagcgtggtagtggtcgcagcggttgaggcgatgaactggttgcagaaggcagctaagctgctggcgcaggaagtcaagtgcaaggagaccaagcagatcgtcaagccttgcatgcctgtacagtggacaacaccggacggcttcccggtttggcaagagtatctggtcactgagaccaagcgcatcgacctgatgttcttgggtgacatccgcattcaggcaaccgtagcggttcgccaatcggacaagctcgacaagcgcaagcaagagtctgggatctccccgaactttgttcacagtatggacggtagccacatgcgccgaactgtgagacacgctttcaaggcatacgcaatcgggttctttgcgatcatccacgacagctttggaaccatcgctgcccatgcaggcaagctctttaaggcggtccgtgagacgttcgtatcgacctaccaattcaacgatgtactcaacgacttccgcgaggagttcttggagcagctacatgaaacgcaactcgaagacatgccgccgatccctcagaaaggtgatctggacatccagcaagtccttctttcggactttgctttcgcctgactatcggtctacgatcctctggagcgccttctgggtgctctatctggtctacttcatctacgccctgatcaacccactgtaaggagtcaccatgaaccgccaacgtgaatgcatccagtacgccaacaaggccgtgcgaattgtgtccttcgatgtgatcgaccgacccggctgtgtcgctatcgaggtcatcaagtgccggtggactggcaaggtgggcatcaagatcgttcaacgctcggaactcatcggcgccttgctggtaagttaaaaaccctcactacggttacacaactcaaattcgctcaaggagatctaccaaatgaacgcacaatccggtttcgttaagacccaacgctctgccccacgtcgctccgacgatgagatgcaggccctgcggtcccggaaaggcaagcgcaacaagagccaacgtggtcagcgcactgagtgggaggctgtatgaaacagcaactcgctgaactcgctgcggagatccaagtggactaccctcaggcccgcattcaggtgtggcgtgagatcgcttctaacgcttggtccctgcaagtgatgtacaatgcgaccactgcggtcgaggtacgcggtatcaactatgaggacctcactgaggacttcttgtgcgatgacctgctgcccgccatcaaatggctccgcactggtggtcagttcgtctctgtcagctacgacaaggccaaggccaccaccaagcacctcaacgaaaccaaacaagcaatcaaggagatttcccaatgaccgctcttacctgcaccatccgcaccacttccagtatgctcaacaagcgcacccttctggtggtctccgaggctcaagctggtgatcgtgtgatcccgatgggccgctggatcttcgacatccagtttctgatgtcccacaagggcctcagtggttcccttgaggagcgcatcgagcagacccgcctcatgcagcaaggtgtcgcagaggaatccctgcgccgtgtactcgccaacgtagccaacaagaagaaggaagcctaagatgagcaccattcgaccagtagtgatcgacaccaacccacaccgtccggttgacttctccgagaaggccattgcgaaggtaatgaagtcgcacttcgtcaccttgcaggtcaaggaagacggttgccaactgaactgggttgtcgagcgcctcttgcagggcgacaagtgggtctacaacgagcacttcctgagccgtgaaggtaaagcctttccggccctcaaggggctccgcgtgatgtccgatgagcactgggacaagttcttcaacccgaacctcggcggtggcctgtaccgtgactatggtggctttatgatccaagctgagatcatggtcctgaacccggatggcaccgacaaggtgtgcgctgagacctctggcgctctgggccgcaaagaggagttgctgacgctggatcaattccgcatcgtggccttcgacctgatccctctgagcaacgtcatccaaggcggtgactacgaggtgatgcagtcggttcgcatggttcggctggctgcgcaaggcacgtcgatcaaggacaccatcaagcgctacgccctgcctgctttcaacttcgaggtggtctctgaggagatcgcaacggacttcgagagcatccaagcggtgtacgacatggagcgccacaagggtaaagaaggtctggtcatcaaggacccgatgagcccatggaagcgcggcaagaaagtcggccagtggaaaaagattcctgacgactgctgtgatggtgtagtgactggtctcatgtggggcaccaaaggcaaggccaacgagggcaaggtgatcggctttacggtcctcactgagcacggtgttgaagtcgaagccggtggcatcacggaagaccagaaggacgagttcacctcgaacgttcttgagcacggccatagcttctacgatggctacgcggtccgcatcacgtacaaagagcgcctcaagtcgggctcgtatcgtcaccctaacttcgacatcttccggggcatcactgacccgtacatcaaggagtaatatgtcctacaaatcgcctgaggaggtcatcgcagcgtttcacgcgctgcctttggcccagcaagtcaaggtaatgcgcctactcatggagtggcagtactctgacgatcttcaacacgacatccactacgccatcgaaatgatccttaaaggagacacacaatgtccgcaatcatcatcgcaaccagtgcagcactcatcgcaagttccgctgccagcgggtctcacggttcctctatgcccatgacccacacgggtgaactgctcgccatcacgcgctggtaatgatggtgatcgccttgtgcttcctgttcgcagcaatgactcgcagcttctactcgaagtgggagagccgtttcgcaatcgctgcggctgtctttgggatcatcggcgtggcatcgctggtggctggcctgatccatgacgtagtggtggcaggatgaatactgtgaccttcttcttcatcatctccacggtgatcctctcgctgctcctctggtcctgctacaagaacggcgcaccagcacgggaggctaaacgggccgctgatgaagctgctcgaaaggaagcccaagcggtagccaagcggcaggccgaagctcagttcgctgctgacgtgatcagtgtccttgaggacatcgttgcgggacgtatcagcgccgagcgttctgactacgggaccactggacgtgagcgctacaagttcgcctctgtgaagctcttgcaggacatgaaaggtgatcgagcggtgatcgagcgaatccttggccgagctgatcgaacccacaaccgcatgaatgacttggagaatggtctgcacgacattcggatgactctgcgtccttaccatccaaccgcgtgcccaaacatcgacttccctgtgatccgcaagggttgacccaacgcctcatctccttcgggaggtggggcttttttacgtctggaggacttgacatgatcaacggttacgtgttactcgcatgcattgcgatctttctttgcggtacgggagttctctcgtggtacttggcgaagtggcttccaatgccgagacgaattccctacgtctatctcagtgaacatttaaaaaccctcactgaggctacacagatcgaatccctaccaacactcaaaggagactacttccatggtgattctgcacagcaacaaatacactgccccaaatgttcacatccgtaccaacaagcacaccagccagaaggtgctcaagaagcgtcctcagatccacaagcaggacggcaaggtgtacttcgttttgcaaagcgacctcgacgccgctcgccagtactgccagcgaccactcgtgtcctataaaggcaactggccccgcttggctttcctctgggctcgtgtgaaggagatcgtcaatgactgagatcatcgccctgaactctttgcgtggtcgctcaggcaaggacactctctttgaggtcctcgttgagaacggcgtaaagatccgtcgcgtggcattcggtgacaagctcaaggagatctgctcgcagaacatcgccttggctcgatccgaggctgctgagctggaagcccacatgcacaccgatgagaaggacgtgctcaaccatcgactcgctatcgttcgcttgccggacaatggctacaagcgctggctgactgctcaggacttcgctgaggctgctcctcgttcgctgcgctggcatctacagcagtacggcaccgagtatcgccgcaagcatctgaacgatcccgatgtgtggttccgtgagggcctcaaggagatcgctaagacgcccgaaggtgagatctgtctcgtgaccgacatgcgccagctcaacgaatacgtgaagctggtcgagatgggcgccaagacggtgttccttctgcgtgagtggtacgtgcaaggtgtcgatgacgcttcgctgcacgagaccgacacggctctattgactgagccattcgacgcctctgtgatcaaccgctggggagatcagcaaggcatgtaccgacaactggtagaacaaggagtcctcaaatgaaaggctttaaagcacaagtgacgcaacaaggtgagatcgaagaagtgaccatctacgcggtggacatcgacgaggctctcgaaaaggccgagcgtgccttcggtcctcagaacgtgggccgtgtacgcactatggtgtcgcccgatgtcaactgggaggtgactcaatgaaccgcgctcagggcaacactcgctcgaacccggatggcttcctgcacattcaaaacttcaccgtgaccaaggcgtccggcatggctggctgtgtctacgtccacattatgaccgacaatgagcgcactgccgttgaagctctgctggtggcgaaggccgaggcccttgaggagatctctggtatcgaggtctgccacttcaagcacggcgtgtggcgcttcaagaagtcgttcctcaaggaagcctttgcgaaggccgtacacacctcgactcgcatcaccgtgagcccagtcgttgagcgcttcaagcagaagctgttcgctgaacgtgaaggcatcttcggggcttgggtcggcaagatctaaaaccctcactgaggctacacaaactcacacttgaaaaggagatacacaatggctggctttaagaaagaattcttcttcacccctcgtggtgttgttgaaccctactgcgctctgcaaaaacctgactacggcaacgaggagaaaggcttcggcaatcctcgtggcgtctggaaggtcaacctgaccctgccgagccgtgaagctcaaccgatcatcgaccgcatcgtgcgctgccatgaaagcaactggcgccagatccagaaggactgggcgaacggtggtgaggctgctgccaaggccaagctgcaacgcggcaagaccctgctgcaaccgtatgaaggccaactgccgttcttcgagaacgatgatggcaccgtgaccttcaagttctctggctatgcgtcgttcctcgacaagaagaccaacgagaacaaggccattgacctgcgtgtcgtggactcgaaaggcaagcgcatcgacaacgttccggccatcgctggtggttccgaaggcaaggtgcgtttctccatgttcgcctacggcttctcgaacgtcgctggtgcatccgtcaagctgcaactcgacagcttcatgctgttgctcttgaaggaattccaagcgggctccgatgactgggccgatgagaccgaagatggtttcgttgccgaggctggtagctctgactgggatggtcacgacgatagctcccagagccgtggtcatgtcgatgaagaagtgcctgacgaagaagatccattctaatggcccgctacgggggcgctaagaacgcacgttctggtgcctttcgttccggccttgaagaacgcaacgcggcccacattgagcgcaacggttcgaccttcgagtttgaaggctaccatgtgccctacgtggtcccagcgcgtgacgccaagtactaccccgacttcctgttggggaatggcatcttgatcgaaaccaaaggcatcttcgagaccgctgaccggcagaagcagttgctcatcaaagagcagcatcctgagctggacatccggctggtcttctcgaactcgaaaagcaagctctacaagggctcgccaacgacctacggtatgtggtgcgacaagcacggcatcaagtacagcgacaagctcattccgttgagctggctgaaagaaccctcaaagacaatccctaaaggagtgttgattcgcaaaggagacaaatgatggcaagagttcagtttcaaccaaggacacgaaccgatttgatcgtggtccactgcgcagcaaccaaggccgacatggacattggcgtgcgcgagatccgtcaatggcaccgtgctcaaggctggctggacgttggctatcactttgtgattcgccgcgatggtcaagtcgaggaaggcaggccacacaacgtggttggttctcacgccaagggcttcaactccatctcgctgggcatctgccttgctggtgggatcgacgccaagggcaaacctgaggacaacttcactgatgcacaaaaggctgcgctccatgcgctgctctggcgctacaccagtggaatcgaacacgatggggcttatcgggatctcccggtggtcgggcatcgtgacctcgatagtggtaaagcctgcccttccttcgatgtcaagtcgtggctcaaagggctccaagagtaaagaacattagggtcgccttcgggcggcctttttgcgttaaggaggttgacaaatgttttacatattgaaacgccgagcgcacgctggctggcttgtctgtgaggttcactatcacggctcgcaggtccgttgcttcggtctgaaagtggtcgctgaggaagtccttgagaccctgcgtgatcgccatccgcaagagcggttccaactgatcttcactgaggaggacatgtaatggtcaacgaacaggatatgaagcgagtacgccgactgctggcactgcttcgcgctgagggtatcgactgcatcatcgctggcggcttcgctcgtgatgtgttcttcgaggcaaccccaaaggacatcgacatcatttgcggtggcgtcgatcactacaccatctccacgttgttcgaggagactggcacgctgacccgtagctacccgaagtacaacggccctgagtctgatcgcttggccggtgtctggaagatcctcgatacgaacatcgacgtgatcctctatgaggtccctacagcactggaagcagtcggcaagttcgactacaacctcaaccaattcgtcttcaatgaggagaccgagaccagccactatgttggtgacggtacgtggaagcgccttgtgcgcctgcgtgatgatgcccgtgggtctcgtcaagccaagatggagcagaagttccatgacctcgttgagcctgcacttgcgagctacgacgagccattctaaaggaggtccctatgcaccctcaggagtactatcaacaacacgggaaaccgagggttcatgttcaggtttggacagaagccaatggacccgtgcccgaaggtatggttattgaccacatcaacggtgataagcatgacaatcgcttggaaaatctccgggcgtgtaccgttgcgcagaacattgccaacagcaagatgcgctcgaacaataagagcggcgttaagggcatcgtttgggatgagtcccgtggccgctggaaggcgttcataacactcaattcaaaacagaaagccaaacgcttcacttcactgctcgacgctgtgtcttgggtctaccggatgcgtgttgagcttcacggcgaatatgcgaggttcctatgagtcaagatgaagaaagagaaggtagtgttttcatcaagcacataccgtgccctgactgtggtagtagtaatgcaaacagtctattcagtgaccaacaccagtactgttacgcctgccctcctgagacagcgtggaagaaaggtgacatggaaggtgacggccctgaacgtcgagccaataccgccaataaggacaccttgagtttcagtgaggcgcaaggccagttccaagcgcggccaaaacgtggccttcaagaggctgtatgtcgtcagtacggctactggctgggtaagcatcatggcaagcactttgagatcgccaactactttgacagtgccggtaatctcgtggctcagaagctccgcacgcccgacaaggagttctcctcgaagggtaagctgagtcccaagtgcctgttcgggcgccagctctggaacggtggtcgcaagatcgtggttacggaaggcgagatcgactgcctatctatggctcagatccaaggcggcaagtaccctgtagtgtccatcccgaacggtgctggccctcaagccaaggctgctgctgctgccaactatgagtacctcgaccagttcgatgagatcatcttgttcttcgacatggacgaaccggggcgtctcgctgcgcaggagtgcgctgaggtcctgccaccgggcaaggtcaagatcgccacactcgtgggcttcaaggacatcaacgaggctctcgtagcgggcaacgctaaggctgtgactgatgccatgtggaacgctgctccattcgttcctgatggtgtggtctctgcgcacgagcttctggatcgcatcaagtccaagaaggatgagccgggtatcccgctgatcggtcccgatgagttgctctttaagaccaagggtgcccgaccgggcgaactgatcctgatcacatcgggctctggttccggtaagtccacctacgtgcgtcagaacgtgttcaactggttctacactcacggtatccccgctggcgtttgtatgcttgaggagtccgtagaggagaccgtacaggacatcgttggtctctacatgaacaagcggattcgacaagagcccgactcgtacaccgagcaggagttcgatacggcgttccaccacatctttgcgagccagaagctgcacctttacgattcctttgcggagtctcagggtgatcggttgatcgccaagatgggctacatggtggacgtgatgggttgccgagcgattgttctcgaccatatctcgattgttgtgtcggccatggatgatctgaacgatgagcgaaagaccatcgaccaactgatgaccaagctcaagacgttcgccaagaccaagggcatcgtgatggtggtgatctgccacttgaagaaccctgagaaaggcacaccgcacgaggaaggccgtcagatcaagatcactgacctgcgtggctctggctccctgcgtcaactgagcgacaccatcattgcagcagagcggaaccagcaaggggagaacccgaacttggtcctgttccgtgtgttgaagtgccgcttcactggtgagacaggcgaggctggctacatgctgtacaacaaggccactggtcttctggaactcacggcgctgaccaatgcgactgcctctggtggtgattggaccggtcacgaggaacccgatcaagacgaaccattttaaaaaccctcactgaggttaaccaaagggcattctcacgagtgctctttactgaaccccacaaggagatccaaatgaacatcaaagaacttcgcaagtaccagcgcaaagcagagtgtgcgttccaacaactggaagcgctgggcttcatctacaaggttggcgaaggtaagccgccacgttgggaaggtaaggatgaccgcatcaccgcaactgaaatccgtgagtcggtcgctaaggctgaccgtgaggcaaccgaacgcgccaacgctctgcacaacgagttcatggcgcagctcgtaaagaacctgcaagaccacatgaaccctccgaagccagagcccgtaaaggacgccttcgagaccggccctcagacgttccctgatcgtcaccgctacattggtcgaaccgctaagctgctgcgcattccgtcttggcacggttgcccacaagcgctgattgggtcggtgttcaccgtggacgagatcaagttcaccaccaagtccaactactctggctacacggtagctggttatctcatgggccagaaggtttggttcccgctgagctgcgtcaaattctaaggagggcaccatgctcattacagacatcgaaactgacggccttcttcgggaggtctctcggttccactgtgcgaccaccatcgactacttcactggcgaacggaaggactacactgaggagacctttgcggagtactgcaaggctctcgaagcggaagccgccaagccagatggtctgatcgtgggccacaacttcatcaagtacgacatcccggcaatccagaagctcaagaagaagtacttcgggacgaacctcaatgttccccgtaagaaagttcttgacactctggtcatgtcccgattgatctactcgaacctgcgtgaaaccgatggtggctacctgcgtacaggcaagctacccggcaagctctacggttctcatgctctcgaagcgtggggctaccgtctgggcgagatgaaaggcgagtacaaggaccagttcatcaaggaccttgacgagcgtggcatcatctacgagaagggcatggagtggcgtgagtgcaatcaggcaatgatcgactactgcgttcaagacgttgtggtcactcgtgctctgacgatgaagctcatcaacgacaagtactacttctccgaggacgctggccctgagggcatccgagcgatccagcttgagcaccaagcagcgtggactctggctctcatggagcgcaatgggttcccgttcgataccgaaaaggccgagcgtctctacagtgatctgagtgcccagcgctctgacatcatggtgaagctcttgaagaccttcgggtcttggtacacaccgaaaggtggcttgtcgatcttcctgcaccctaagacgggcaaggagctgccgaagtacccacgggtcaagtacccaaaggtcggcgggatcttcaagaagcagaccgctgcccaagcgaaacgcggtgagttcattcaggacactcgtgacttcgttgagggcgctccatacaccccggtgatcttggagaccttcaatccgggttcctctgcgcacatcgttaaggttctcaaggacgccggttgggtgcccactgagttcactgacaagggtgcgccgaaggctgacgatgagacactggatggtgtccgcgtagatgaccctgagaagcaagcgtgcatcgacttggttcgccgttacctgatgctgcaaaagcgcattggtatgctggccgagggcgacaacgcttggatgcgaatgatctgggacgaggatggctgcatccacgggaacatcaacccgaacggtgcaggaactggtcgagcgactcacagctacccgaacatgggtcagatcccttcggccaagtccgagtacggtcctgagtgccgtgagctgttcggtgtggtcactatccgcaagcgcttcaaaggctgggagaacgctgtgcaaatgggcacggacgccgctggccttgagctgcgctgtctgggtgcctacggggctcgctacgacgatggagcctacgttgagcaggttctcaatggtgacgtacactgggccaacgcactcgcctcagggctcgcaccagcgggcttgaagcgcgacaagtcgaaccacactcacgactcctaccgagacaatgccaagacgttcatctatgcgttcctctatggggcgggcgatgggaagatcgggcagatcatcggcaagggcgcgaaggaaggcaaggcactcaaaaaggcgttccttgagaacaccccagtgatcgctgcactgcgtgaggcaatcgaatcgggtctcatcgcagaccagaagtggaaccaagcggccaagcgtttcgacatcaagtggaagcgcaagtggttgcgtggcttggatggccgtaagatccacgtaaggagtcctcatagtgctctcaacttcctgctccagtctgccggtgcgatcatctgcaaggcttgggtagtggagactgagcgactggcattcgaggctggtctcaagcacggctggtatgacgatgatggttccgttggtgacttcgccttcatggcttgggtccacgacgaactccagatcgcctgccgcactcctgagatcgccaagcagatggccgagctgtctcaacaagcgatccgcaacgtgggcgagtccttcgacttcgcttgcatcctcgataccgatgcgaaaatcggtgacacatggcgcgactgccactaatcaataggcccttcggggccatctcaaaggaggtccaaatggctatcactatgaaggctcacgtttcgttcccactgactatcgttgtggctaccgagaccatggaatacatcgcggctgctcgtggtgccgtaaaggcgctctctgaggagtaccgtgcgaagaagttcaaggacgccaacaagctggagcgtgcgaagctcgaactgttcctgagcgacaagactgacgagcaagtggtcgagtggatctaccgttcgagcctgcgtcagttcatccgcgacgaactcaagaaagaactctgcaacgatgaaagcaccgctcgcattggcgacacccgtgtgaccttcgagcagaaggcggtgcctcgtgtctgaatacctaaaggttctttgggaactcaaaaagcaggctcgtacctatcagagtgactttgtgcgttcgcgcatcgctctggtcaacgaggctgcatcccgtgggcacatctcgtgtgtgtccgtggctggcaagaacatgggtgtttggtcgctcactactgctggtcaactctttctgtccgaacatggaggtgctctgtgaaaactttctattgcgtatgtggttgccaaggttgccgtggtggctgctctaactggctaactggctggggtgatgcatgacgaaagctgaggcttacgaattcctacggggcgctcttgtggcgtccactaacaacggcttgagtcagtacgctgtagcggcactgctcgccaagatcaatcaggaggtgaaggaagatgagtaaaccgttgcgtattggcttgggctgggacatggactacatgatcttctcggccatgtctggagccgaagtagagaccgactggggcgacgatgtgtggacccttgagtgtgaccatgggaaagcacgtaacagcctgtacagcgccatgaggagcatcaccgagcagatcgaggaggacatcaaacggatctcccctaagatgcgcaaggacggtgccttcgagctggtggacttggcgatcatctctggtggtggcaacttccggttcgacgttctggagtcctacaagggcaaccgagtgggcaagcgtaagcctgttggctaccgtgacttctgcgacaagatcctcgcccagcataaggagaactcgttcttctggccgggtgtcgaaggcgatgacgttctgggcatcctctcgaccaacccttcgctggctggctgcgacaaggtgatcattgtgtcctgcgacaaggacttctacacgatccccggtatgttcaagcgcctgtctgatggctccttcaaggtgtcctctgaggccgaggctgatgcctaccacatgtaccaaacactgatcggtgataccactgatggctacggtggcatcgttggtgtgggtcctgaggctgcgaagccgttcctcgctgacccggtgttctactatcaggacgtgaaggttatgaagtccggcccacggaaaggccaagaggttcccttctggacatctcgcccgcctaccgatgaggaaaccttgtgggattgcatggtgtcgctcgcagcgaagaacaacatgactgaggcagaactcctgcaacaggctcgtgtggctcgcatcctgcgtgacagtgacttcgatcacgagaccaagcagccaatcctctggactccgggtagttaaaaaccctcactaaggctatgggaccctttaggttattcctttaaggtccctcatggaggtgacatgctttcagcaattcaacactacatcgacaaccctgatgacatccctgatattcctcaggcgtcagcagattatctggctgctcgatgcaacgtctcgtacatccaacgcactggcatcctcgaccagctccgcaaggagggcttctctgagcaggctctttacgggttctgtgagggtctttcggcagtcgttgagatcatcgagctgatgcaagagcagcgccacctacaggaataggaggtccgcatgtgctttagcagcaagacgaaacaacctaagaccaaccctgagtcccttcgagcaccagagcctgtcatggccgaggaaccgaagggcgtagagttcggtgatgaggactcggagttcgatgagaacatcggcactgagggtctcaaggtcgaaaaggaaaccaaagcgactggcgagggcactcaacgttcccaagcatctgacaccggtggtgttaagaagtcggcaaccaaaccgcgtagctccattcgccgcgcattgaaataaggagaatcctcatgggcttcggcaagaaactgaaaaaggctttcaagaaagtgaccaagatcgcaggtagcggtggtggtcttctgggtggcggtgatgacaagaaagatcgcccagcagcagaagttgcagctccagcaggcgctgcggcagtcgtagaggctccgaaagaagacggtgtggatgcagatgatgctgacaccgaggctgctcgtaaagccgccaaagcgaagggcaaaaagaacctgagcgtggctcgttcgagcgggagtggtctgaatatttaaggaggtgaaccatggcaactgaacgcactggtctcgctgaggaaagcgcaaagtcagtctacgatagattgaagtctgatcgagcgccctacgagacccgagcggagaactgcgccaaggtcacgatcccctccttgttccctaaagaggccgacaacgcctctacggactacacgaccccatggcaagctgtgggcgctcgtggtctgaacaacctgtctgcgaaggttatgctcgctctgttcccgctgcaaagctggatgaagctgaggatctccgagtggcaggccaagcagttggtcgctgacccggcacaactggctcaggtagaacaagggctgggcatggtagaacgcatcctgatggcctacatggaagccaacgcttaccgagtgacgctctttgagttgatccggcagttggccctttgtggcaacgggtgcatctacctaccaccacctgacgcaaccagctccgcgtacaacccgatgaagctctacaccctgcacaactacgtttgtcagcgtgacgccttcgggaacgtcctacagatcgtcaccttggatcgagtagcctatgcggcgctccctgaggatgtccggtcgaagctggatggtgaacacaagcccgatgaggaaatcgaggtgtacactcacgtttaccttgacgacgaatctggtgactacctttcgtatcaggagattgacgatgaggaagttgaaggaactgatggtcagtatcccggcgatgcttgcccatgggtcgctgtacgctggaccaagcgcgatggtgaacactacggtcgcagccacgttgaggaataccttggggatctaaactcccttgagaaccttcacgaggccatgatcaagttctctatgatcgccgctaaggtcatcacgttggtgaaccctaatggcatgacccaagtgcgccgactggttaaagcccagagcggtgacatggttccgggccgcaagcaggacattgagttcctgcaactcgaaaagaccgctgacttctccgtggctaaatccgtggctgacaacatcgagcaacgcttgtcgttcgtcttcatgttgaactctgcgattcagcgcggtggtgagcgagtcactgccgaggaaatccgttacatggcgcaggaacttgaagatacccttggcggtgtctactcgatcctctctcaggaattgcagctacctatggtgcgcatcctgttgaaccagttgcaggcgactcaacagatccctgacatgcccaaggaagccgtagagccaaccgtaagcactggcgtagaagcactgggccgtggacaagacctcgacaagttgacccaattcatgcagatgatgcagatgatgggcgcaattgctcaggaccctgatctcaacgtggctaacctcaagctgcgcgccgcgaacgctattggtctggacacctctggtctcctgcttaccgaagcggacaaggcgaaggcgcttggtcagaacatgttggagcaaggcggtgctgctgctgcgcaaggtattggtgctggtgtcgctcaacaggcgactgcgagcccagaggccatgcaaggagctatggacaccgctggcgtacaggctggaccgattccctcggctggttaaaaaccctcactaaggctacagataggcaatcccgtctgtggccttcattctttaaggagatctaaatgtctgatatttatgctgaattcggtgtcaacaacgcggtgatgtcttcgagtgatcctgtagagcacgagcagaacatgctggctctggacgttcgagcccgtgatggtgacgacgagctggttctcaacgacgaccaagagggctccgaggaggagcatgaggaagaagaaactgaggagcaggaagaagacggcgaggagtctggtgacgaatccggtgatgagagcgatgaaggtggcgaagaatccactgacgaatttgctccactgggcgaacccggcgaagatctgttggctgcttctgctcaaatcgaccagtacgctgagggctttgagagcctgcaagcgcaagctgtagaacgtggtctcgaccctgctgttgcccaagcgatcatcgctgaggtggacgagaacggcgagatctctgaggccaacttgaaggcactggaagctgttgggtatacccgtcagttcgttcagtcctacattcagggccaagaggcaatcactcaggcttatgctaacagcatcatctcgtatgctggcggtaaggctcagttcgatgccatcgttgcgcatctggaagcgaacaacaaggacgccgttgagaccctttatggggccatcgagcgccaagacctcgctacagttcgcaccgtgatcaatctgggcatggctggtcgcaccaagaagttcggtgctgctcctgctcgcaacctgtctcgacgggcacctgcaagcgctccacgagcacaacgtcaaacggtcgctggcttcgagtcgaagtccgatatgaccaaggcaatgggcgataagcgctatggccgtgacgctgcgtacactcgtgaagttgagcagaaagtgatcgcttcgagctggtaattaaaaaccctcactaaggctacagataggcaataccgtctgtctgttgtcctaaaggaaaccctaaagaaaactcatagaaggagattcacaaatggctaaaatgaacggcggtcaacaaattggtaagaaccaaggcaaaggcgttaacaacccggatgctctggccaacttcctgaaagtcttcggtggcgaagtcctgactgcattcgtgcgtcgttccgttaccatggacaaacacatggtgcgaaccattcagaacggcaagtctgcctccttcccggttatgggtcggaccaaaggttactacttggcaccgggcgagaacctcgatgacaagcgtaaggacatcaaacacgctgagaaagtgatcgtcatcgacggcctgctgacctcggacgtgctgatctacgacatcgaagacgcaatgaaccactacgatgtccgctccgagtactccgctcaactgggcgaggctctggctatcgctgctgacggcgcggtactggctgagatggtcaacctgtgcaacctgcctgccgcttccaacgagaacatcgctggtctgggcgctgctgttgtactggaaatcggcgctgccgctgacctgaccgatccagaagctcgtggtatcgctatcctgaaaggtctgaccttggcccgtggccgtctgaccaagaactacgtgcctgcttcggaccgttctttcttcacttcgcctgacgactacagcgccatcttggctgctctgatgccgaacgctgcgaactacgctgcgctgatcgacccggaaaccggtaacatccgcaacgtgatgggcttcactgtgatcgaagttccgcacctgaccgttggcggtgctggtgatgatcacgatggcaccaaccagaagcacgccttccctgcgaccgccactggcgatgtcaaggtagctgctgacaacgtggtcggtatcttcaaccaccgttcggctgttggtactgtgaagctgaaagacatggcgcttgagcgtgctcgtcgccctgagttccaagctgaccagatcatcggcaagtacgcgatgggtcacggcggtctgcgtcctgaggctgctggcgcactggtggtcacaaaggcgtgagcatcgttggcgtaactggggttacgattgcacctaagacttctacagtcaaaatgggtgcaactcgtaacctgaccgccacggtcgctccagctaacgctacgaataagtcggtgacgttcgcaagttctgatcctctcattgctaccgttagtgcatctggcgtggttactcccgtagctcccggctctgccaccatcactgttacgaccgtagacggttcctttaaggacacctgcgcgcttaccgtaacggctgagtaaaccgaaccccttgaggtcccttgtgggcttcttggggtttttactttaaggaggctctatgcgttctattgaagcaacactcgaaaccgctgaggaactctctgcgatcaacgacatgttggccgctatcggagaatccccagtgaactcccttgagggcgaccctaacgctgacgtagcgaactgccgtcgaatcctcaatcaggtcaaccgcgaagttcaatcccgtggctggaccttcaacattgaggagggtgcgaccctgatccctgatgtgttctctcggcagatcccgtacatgagcgacttcctaaagatgtcctctacgggcggtacgccttacatcaaccgtggcggcttggtctatgaccgactcaatgacacggatgaattcacctcccctattcaggtcgatctgatccgtctgcgggagtacaacgagatgcctgagtgtttccgctcctacatcattgcgaaggcttgtcgtcgcttcaacatccgattcttcggtgctggggagatcgaaggggctctgcaagaacaagagcaggaagcgtggcagatgatcaacgaatacgaactcgacttcggaaacttcaacctgctcgatggtgacgcatgggttggcgctaagatcagtcgttaaggaggtcttatgggacttgtttcacaaagcgttaagaacctcaaaggcgggatcagtcagcaacctgacatcctgaggtttcccaatcagggcgcctttcaggaaaacggttggtcctctgagacccaagggttacagaagcgaccgcctacagtgttcgttaagaagctcgctgaccaaggatctttcggtggtcaaccgctgatccacatgatcaaccgagacgccgtagagcaatacgatgtggtgttcactgggacctccctgcgggtctttgggttggacggtacggaatacacggtgcgtggatatgatggctatgcgaacacggcacagcctcgtaaggatctgcgcatgatcaccgttgccgactacacgttcgtgaccaacaaaggaaaggtgacggacatggacaagaccctgacgcacgccggatcgaagcctcttggtcaacgctgtgtgatcaacgtgcggggcggtcagtatggtcgcaccttgaagttcggcatcaacggttcagactcggacgctgttctggggatgccagcgggcgatgttgccgactaccctaacccacctgcgggaaccccagccaaacaggttgagtggaccgatgcgggcttcattgcacgagagatggctaagcggttcgatgcaaccatgacggctgctggcaagccgtacagggccactgctgggcaaggatggattgttgttgacgcgaatggtggtcctgacatcacttcggtgaagacagatgacggctatgcgggtcagttgctcaatgcgttcctctatcaggtccaagcgttcaacaagctgccatcgcaatgtgtcgatgggtatctcgtagaagtcactggggaagctgcacgatctggcgataactactgggtccaatacagctcctcagggctcgtatggaaggaggtagccaagccgggtatcattgcggggctcgataagacaacgatgcccagagcgcttgtgagagccgctgacgggaacttcgactggaaggtactcgactgggttgagcgtaagtcgggcgatgatgacaccaacccgatgcccagcttcattggtgcgccgatcaacgagatcttcttcttccgtaaccgtctgggtttcctctcaggcgaaaacgtgatcatgtcgaggacctcgaagtacttcaacttcttcccttcgagcgtggctcaggtctccgacgatgatcctatcgacgtggctatcagtcacaaccgcgtgtcgatcttgaagtacgctgtgccgttctctgagcagctcttgttgtggtctgaccaagctcagttcgttctctcgtctgcgggcacgatgacttccaaaagcatccagctcgacctgaccactgagttcgacgtgagtgacggtgctcgaccatacggaattggacgtggtgtttacttcgctgctcctcgtgccagctacaccagcatcaagcggtactacgcggtacaggacgtgagcgatgtgaagtccgctgaggacatctctgcgcacatcccgagcttcatccgaaacgaggtcttctcgatccacgggtcgggcactgagaacttcgtagcgatcctctctgacggtgatccttccaaggtgttcatctacaagttcctgtatctcaacgaggacttggcgcaacagagctggagccactggacgtttggcgatgagaccaaagtgctctctgcgacctgcatcggttcctacatgcacgttgtccttgagagaccttctgggatcacgctggagcgcattgagttcacagcgaataccgtggatattgcgatggagccataccgcgcctacatggacatgaagactttggtgagcgctgagaccttcaacgaggacctctacacgaccaccattgacgtattgtcgatctacggtggcgtccttgggcctaacgttgtgctgtacacgctggatcaacatggcgtccttgagagacatgaggcaccacctcgtggctggatcgctggctccaagatcgaactcgtgggagatcgcactggtgagaagtttgtggttggacgtgaatacacgttccactatgagttctcgaagttcctcatcaagcagaccgctgacgatggctcgaccagtactgaggacattggccgcttacagttgcgcaaagcgtggctgaactatgagcagtccggtgccttcgaggtcaacgtgtacaacggctcaactgagtacgtgtacaacatggctggcggtcgcttgggtactgagctgatcctcggtagcttcacgctgggtactgggcagttccgcttcccggttactggcaatgctctacgacaacaggtttccatcgtcagctccaacccgaacccactcaacgtgatcggatgtggctgggaagggaactacattcgccggtcttccggtatctaacaggcttggcgagggcgtaaaaaccctcactaaggccataggaggcttaaagttatgactctaagaatcattaaggcaactcgtgatcacctcgtgacagccgctctggatctctccaagggcgaccttgaggagttccactgcaacaaggctaaccgcaatccggttgacgttctccctctgcacctcgactcgacaacccatgcgattatgcttgggtctttagttttggctgtaggcggttctcgccatccagacatctggtttgtcacgacgaacgtggttgagacactcgaccgggcagaacgcttcggcttctacaggctcctcaaagagcaccttgcagatgtccgtgatcgtggcccgaaccagagcttcaccaacttcgtgtcgaagaacaacaagggccacatccgactgctggagtcccttggggctaccttccagtccggctatgtgatgtctgaggccgggtttcaattcaagcaattctggctataggaggtcactgtcatgtgtgaaccagtatctatcggcctcgctgctgttgcccttatcgggggcacgatggcagctaaggacggcgctaaggcacgaggtcaagcgaccgatgcccagcgtaagacccacatggaacaagtccgtgagatgaacatggctaacgccaacctcaacttggacatgaaggacaaacatgaagctgcccgtgagcacctcgttgaggtcaacttacaggctctgcggaatgagtccactgtacgggccgctatgggtgagtcgatgctgtctggtcgatccatgaaggccatcaagaatgaggtcgctaaccagtcctcgaaggagcgcgtaatgaccgctcagaactatcagcgtgactaccaatcaatcttcgccaaccagatcgccaacaccgagaacaccaagtcctctatccgaggctctggtcgaatcttccagccgaacaagctgggcacggctctgggtatcgttgggtctacagcttcggctgctgcatctggctacaaaggcaagtctggtggtgatgcacctgcaccgaaaggaggagcagccacatgaagaacgcaatccaaggcgccgtagagcaagctcgtggcggtcaagtagatcgcctgcacggtgcaacagccacacagaacttccgtgcgtcagtccaacaggctcctcaaggagacacctcgtgggccgaaggtatggcgaagttcgcaaagggcgctcaggatgcttacggcacctatgagcagcgtcagaagtccttggccgatgaacgctccaacgagatcatccgcaagctgagccctgagcagcgccgtgaggcacgagctaatgggacccttctgtatcaggatgaccagtcagtgatggaagccttgagcttcaagactggtcgcaacgccgcctatgaggtggatactgagatgaagaacgacttggcccgctatcgtacccgtgaggagttcgatgaggcacgtcaagctcgtatgcagcagaaggccaagaactacgccgaggccgctggggttcgtgaagacgatccgttctaccagcaaggcttcaacgataacatcacagctcgcaacgctgctctatatgacagccatgcgcagttcctctcgaagcagttgagtgcccagtccacactggaagcacgaaacgacatcgctccgatgatggacgacatcaccattatgaaggaccctgcggcgggcaagatgtttgccagctatctgaacaagggtctggagtctggtgagatcccgactgaccaagaggccatcgacacgctgaccatgttggcgaacgatgcggttcataaagaacacggcttaaatctcttggacaccatgggtgagcaggagctgaacgtcctcggtggtaagcgcaagatcaaggacatcttcggtcctgaggtctatgagaacctcaaaacgaaagccggtgagcaagcctatcagcgcaacgctgagcagactcgtcagcttcaactgggcatcactcaggccgagaatcaggatgaccctgcgaccggctggcagatgatccagaagctgcgccagcagaatgcttggctccaaagtgatgacacgctgactcctcaaaagcagcagctcattgcggcagagcaacgcatcctgaccaagacccggatggataccgaagcgcgagctaagggtgtcgttaaggccactcaggctgacaaccggattgcccagttgcgccgtcaatacgagtcccgtatggccggtgagaacgtcaacgtgcgtcctgaggatcaacccgtagatgacagcaccggtgagttcaaacgctccgatgccatgtcgatggctcaaagtgtccttgcggacatcaagaactccggtctgcctgaggcgaagcaagacgaactcaaggctggataccttcgggccgactatgagaacggaccgtttcaggagatgttcaagaccaacatcacggacgctgagcgtgagtggcaggcggctctggttacaggtcaagctggtgacttccctcgcatcaacgaactcaaccgtgcctacatggctgacccttcgaccatctcgcagttgtacccggataaggctggcttccttgaggagatgaacacgatgctgcgttctggcattgaccctcagatcatggtcgagaaggccgtgggccgtaaggctctgtccaaggatgagcagatgttccaagaccagcaatgggcttcggtcaagaacgatggcaaggctcctgaactctctgcgcttccgcgtggaatggaacagaccgcccgctcgttgttcgatgcgttcaacctacggactggtgatgcgaacactgctgctgatgaggtctcgaagtggctccaagagaacaccgtgcagtttgccgatgaaggtggatggcgtgactctacggcccgcttggggatgctcaacaagaaggacctgatgatcgacccgaacaacatcaagtcgtgggaacagggcaaggcgattgtcgataagactcttgctgggctcaaagagatgccctactgggctggctccaaggtaacagtggagtcgaacccggctggagacattatcctcaagtcgttgaacggtaagcagatccgtatgaccaaggaacagatgcgcctgattcaggccgctgaggaacgtgcagcagatcaagcacgcatggccgataaggtcaaaggtgcgaagaaacaacaggaactccacgagcgttacattctcggtggaggccgtaaacagtaacgtatagaggagatccactatgagtttcgatcaagagtatgaggccatcaaggccagcggtagcgagtacgacgacctgattcgtcaagcagcagatacccatggcgtgagctatgactacctgcaccgcaagttgtactacgagagccgcttcaagccggacgccaagagccctacagggccacgaggtatcggccagatgaccaaggccacgggagctgcgtatggtctcaagactgacgctgatttcttcgatccggccaagagcatcgacgcggctgctcgattcaccaaggacctcgtagggaagtacgatggggattacctcaagacttccttggcgtacaaccaaggcgaaggccgactgggcgctcctcagttggcagcgtatgacactggcgatctctcgaagatctccaatgagggccgcaagtacatgaaggcgatggcaccagtcgttggcgatagtccgggtctgcaacgtttcccaaaggattcggcctctgacttcgataagttcaccgctggtacagaggccagttccaaggtagctcgcactggaggcgtcgaggttgacgctttcggtcttgctcaaggggaaacaccaacgctccaaaagggcgcccgtgagatggagatcgaccaagaggttgctcaaggtcctgaaaaggacttcttcgagggcacttggcaggcatccaaagattaccttgcgacatcgcctctggctcagatctaccggaacgtgaccgttgaggaccacgacccgttggactgggtgaaccctgcggacacttcgagctggaccgatgaggacttccagaagatccgtgaagaaggggttgatcctcagtacttcgggtttgtcatggagaactcccgtgggcaccgctcgaacctccctaactcaatcgcattggcaaaggagaacatggcctatgatgaacgaatccgttcccaaggtacgggagcccagtttgtgggcggacttgttggcgctgctggtgatcctcttacttacactcccatccccggtcttggtagtggccgcgtggtatctaacgtggtcaagcaggcagcattttcgggtgcaatgtcagtgggctcggaagccctgcgcgaacaagcgactggcatcgaaggtcattacggggctgcgctggttggcggtgtcgtggttggcggtgggctcgctgctctggttgagcgtatcgctgctcgaaacgcaccggctcctcgcatggatatgtgggacggcgacctaaacaagttccttgagatgcacggtgagtctgcacttcccaacgagttcgcctctgcgaccactcgaatggaagcccgtgagactgcacgtcagctcggtcaagaagacccgtctcgtatgggttggctggatggcgaggagattcactctcacgctggtgttgactacacaatgcatcctgatgaacccggtgctgttcgcttgggcgatgggtctatcctgtctgcctcgaacccactgaaccctcacacgcaaagccagttcacctcgttggaacctcaaagggccgctcgtggtttcaccatgggtggcttcactgagattggctacacgctgaaccgttctgagaacgtagaggtgcgtggcattggtgagcagttgttccgttccactacagggaccacaacgggaactcatggtaagttcggtgcaaccgcatcggatgtcattgagcgcatccaagcgcaagacaacctgagccacaaccagatcgtgcagtccgtcaaggaggcgatccgtgatgtgtcctatgcttcccaaccgggtactcgtcaagccaagtatgagatggcctaccgtcgcgctgctgaggcgattgaggacactacaggccaacgtgcagctcaactcacagaaggcgagcgcaagctcatggagaccttgaagaagcacttcgaccgcaaagcagatctccttgagaaccctgctcagttcggcaaccggaacgccacttcgatcctccctgagacacgccatgctggttcgtacattcccaacgtctacagcgatgctgccaaggccgagtggattcgccgcttcggtgatgctgatggtttgcaaaatgctatccgtgaaagctggctggcgtcctacgcttcccgtgctcatgtgaagcagcgtgttgaccgtttcatcaaggaacagatcgagaaggaagggcaggttgcaacgcctgaggctatcgccgctcgtgttgaagactacgcccacaacaaggcttttggtatcagccacactcacgacttcaaccgtagctctctcattgacgatcaagtcgatggtggtctggttggtgctgagaacaacaacttccttgaagcgcgtcacctgttcgattcggacatggagatcccgctgaacagtggcgaggtgttctcggtgaatgacctgcgtgagttcgacttgggccagatcactccatcctatgaccgccgtgttaacggtgatattgggatcatggctgcaactggtcaagacaccaaggctctcaaggaccgcattgcggctctgaaagttgccaagggttccgacaaggagatcgctgcgctacaggactccgtgaagctgctgacaggccgctctcgacgtaaccctgataacgccttcgagacagctttgcgtgccctcagtgacgcgagcttcttcgctaagaacgcctacatgggtgttcagagcatctcggagatcgccggtctggttactaaagggcaccttcggatgatgatgcacggtgtgccgtacctcaaagagatgaccacttggggctccaagatcaagcctgctcaactcaaggagatgcacgacctcgtgtttggccgtgagctggacaacctgatccgccctaagcgttcggacatcgttgagcgtctgcgtaaccaagggtcctcgaacatcaccgctcaggtggtgggcaccatgaagtttggtactcaggagctgtctgctcgcagtccgttcactaagttcctcactgagtcctcgaactacatctctgacgctggccgtcaaggtgtgatgatggatctgatcaacaacgtacacagcggcaagaagtccaagctgttcacccctgagcgcctcaagcagatgtccatcacgccagagcaattcgctggcatgaagaacctcgttaagaagcacttgaagcgtcagccagatgggcagtacaagatcgtcaacgctcaggacatgcaagcggaccctcgctcgatggacctctggcgtatgggcgacaagatcgctgacgagaccatcctgcgtccgcacaagttgtcctctcaggacaccaaggcgtatggcgctgggatcaagctggcgatgcagttcaagaacttcaccctgcgttcgatgaatggccggatgatccgtggtatccacgacgccaccaagaacggtcaagcgattgaccaagtgatccagcaagccttggctctgggtctcgcagtggcaacctacgctggcatgaagtacggccaagcggcttcgatggacaaggagaagcgtggggacttcctgaacaaagcactggacccgaacatgctggcctacgctgcgatctctcggagttctcacgcgggtgcccctatgggtatcgctaacctcgtgttggctcctctggggttcgatcaggctgcaatggtccgttcgtccatcctccctcgtggtgatcagaagcgccagcctaaaggtggcccaatgctgtaccaaccgtctcgctctgatgacgttcagggtttcctttcgaggtcccttgagcaagtaccgggtgctggcaccgttctgtctgcctatcaggttggacacagtgctaccggcttgacccgtggagaaggccgcaaggctgatcagggttacatgcaagcgatgtacaatggtctgcgaggactcatccctaacgacccgatgtcccagcgagttctcttggctctgatgcaagagcaaggcatgggcaccgagtaaaaaccctcactaaggccacatagagatcattctgtgtggctattttttaaggagaaccactatggctttagcaccaaagacggtttacacctacccacttgacggttccaatcggacgttcaacatcaactttgagtacctcactcggaagttcgtgcagatcaccttgattggtaaagaccggaagctgctggtgttgaaccaagactaccgtttcgtaactcgtacagcgatccaaacgaccatcgcttggggtcctgctcaggaatacgacagcatcgagattcgacggttcacctctgcgaccgaccgactggttgacttcgcggacggttcgatccttcgggcttacgacctgaacatctctggcatccaagggctgcacattgccgaggaagcacgggacctcactgcggacaccattgcggtgaacaacgatggcgacttagatgctcgtggtcgcaagatcgtgaacctcgctgatgctgttcttgacggtgacgctgtgacgctccgacaggagaaggcgtggggagagtcggcgctgaaccaagcgaaccgggctcaggcccaagcgaacctctctgaggcatctgcgggccgatctgcaagctctgcaagccaatctaatgcttccgccgtggcgtcctatcaggatgcggaacggtcgatcactgcgcgccaacaaagcgagaacgctcagatcaactctgagactgctcgtgacaaggcgaagctctgggctgaggcaccatctggtactcaagttgagccgggtatgtactccgctcgtgcatgggcactgacttctggcgactacgcgggtaaagcacttgcaagcaagaatgccgctgcgaaaagccagactgctgccgcaggtagtgcaggcactgcgaagaccgaagctgaccgtgccaagacagaggccgataagttgggcaacgcgaacgcattcatgggaacactcgataaggttgaaggcggtgtccctttctggaaaagcggtggattgttcacatcctatgtgtcgataaagcgtcaaggagcccaagctggcggttatggcgatgtcgttcgactgatccatggagatgaaggtcgcttcgctattcgagatgagtggcgcggcatcacgcggatgcttactgagaccaacggcgacctatctgtctacggtactgtgtggacgcctacagtgcgtgcaacacaaggctccctgttctccattgctcccggtaacgggaactgtcactactggtttgaaggacctgaggccagccgtggggtcatgttcgcgggacctgatcaggtcatccgattccgtggtggaaacgctaacgtgggcctcacagtgaaccctaacggtgacatcggggttggccgtaacgttgctctcggcgcttcctacatcgactcgactggtaacattacctcgtccatcttttctggtggatcgctctccgcgcacctcgccaagttgtcctctgtgactcctcggagaatggtgtctgttcaagtctttacaggctcaacaggtaatggttctgttatcaccctctcggatgatgcgttcaattacgagttcttctgggctaactattctccaaccccagccgacaaagtgatgatcactggtctgcgtgagcttgccaacatggatctcaacctgactgcgtacatcccagtaggtccgaacaactacatcgcaatgaagttcgttgacactgacccgtcccagcgccgtaggttgcaccttgtgcagtttgctgccaactccggtttcactaacctgtacggtatgcgatacgctgctgtcacgtaaggaggactcaatgctttccatagacttcaaggaaggcgtcatcaaggctgctcccattgcgggggcggctaccgctgacgttgctacacgtttccaagggttgaccatgagcgactggttttacatcgccgtgatcatctacaccatcgcgcaaaccgttgtgatgatcttcaagaccgtcaaagacgagcagcgcaaagacaaggagggataacctatgtcgtctgacgttctgcaacaactgctggaggccatcgacaccgagaaggcccggtacatgctgtctgacctgcgtgaccctgagaagcgcactccgcagctctacaacgcaatcgagaagctccttgagcgccacaagttcaccatctccaagctgactcctgatgcttcccttctgggcgagctggcgtctgcactggatgaagtggatgagcttactgacgctgagctttacactcaacactaaaggagaacccatatgctcaatctcaaagagatcgtcatgtgggtctttctgttactcgctgcggctggcttgatttacgtcaagggtcgcacagatgaagcagaggcccacaccaagaaactcaatgatgcgcagatcgcgctgatgaaacaaaaggaggaacatcgtgttcaacttcaagagacccaaagcaagattgaaagtgagtggcgccaaaagaaccagttggtggcgagcgctgctgctcggactgtggatgagctgcgtggtagtaacatccggctgtcagtcaagctcgcagatgcaaccgtcgccagcgtcacagacggtaatcagtgcagagctgatggccgagccgaactacaccgagagacttctgaatttcttatcggagaagcccagcgagcagacgcccaagtaaaggccctgcaagcaaccattcggaacctacaggaggtgcgccatgagtaacgctcagaagcgccgtgcgcgcaccaaagaggaggagctggcctacatcaagggtaactttgttgtcttcctgttcgtcctctggcgagccctgaacctgcctaagccgaccaagtgtcagatcgacatggctaaggccctctcagggaacccaaagaagcgattcatcctgcaagccttccggggcatcgggaagtccttcattacgtgcgcctatgtggtgtggaagctctggaacaacccagacctcaagttcctcatcgtgtccgcatcgaaggaacgcgctgacgccaactcgatcttcattaagaggatcatcgacctgttgccgttcttgcaccacctcaagcctcaagcgaagcaacgggattcgaccctgagctttgacgttggcccagccaagcctgaccactcgccttccgttaagtcggctggtatcactggtcagatcactggttcgcgtgctgacatcttgatcgcggatgacgtggaagtaccgggcaactctggcactcaggccgctcgtgaacacctcgccactttggtgactgagttcgatgcgatcttgaagccgggtcctgacagcctgattatctatctgggtacacctcagtgcgagaacacgctgtaccgctcgctggaatccaaaggctacagcaccaccatctggcctgctcgctatcctgccgatcagaaggctctggaagcctatggggatcgtttagcacctatgctgcgcaatgaccttatgaaggacaatggcaccttctgggagcctacagaccctgtacgattctccaatgaggatctcatggaacgtgagctgtcctacgggaaggctggcttcgcaatgcagttcatgctcaacccgaacctgagcgatgctgagcgttaccctctgaggctgcgtgacttgatcgtagggagcttctctgcggacatggctcctacgtccttccagtggatgccaaaccctcagaacctcgttcaggggctcccagtgactggcctcaacggtgatgcgtaccatcgctatcacagtgccggcaaccagtccgctgagtacaccgcaaagatcctcgtggtcgatccaagtggccgtggtaaggacgaaaccggctgggcagtgctgtacatgctcaacggctatatcttcctcatggacgctggtggataccgtggagggtacgataaggagaccctacagaagctcgccaacaaggccaagcaatggaaggtcaatgaggtcctcgtagagggcaacttcggtgatggcatgtacttgcagctcctgactcctatccttaccgctacgtggcgctgtgcgctcattgagaccaagagcaagggtcagaaggaactccgcatctgcgacgttctggagcctgtcatgggcagtcaccgtctggtggtcaatgagaaggtgatcgaggatgagtaccgccttgcccacgataactacaaggatgacggtgggatcgagactggatcttcctacagcctgttctaccagatgactcacatcactcgtgaccgtggagccatcaagcatgatgaccggctggatgctgtagccattggcgtacagtacttcaccgagagcatggcgaaggactcgaaggttggcgagagcgaactcatggaggaattccttgagcaccacatgagcgatgaccgcatgggcttcaactcgatgcgtgaactgaccatgggtgactgctcgatccagtacgaggatgacggtatggtgtccaactacatgggctggtagatttgcacgttagcgacacgttcgacgaagattaaaaaccctcactaaggccccggagagtccgttcctatagatacttaaagagcacagttcgatgaacatgttctcagaagttcctctgtagggaccctctctggtgccctctgtgatgatggtgttattacacctcacacaatcaacatcaaagggagactcacatgaagaccactgctaagacgtggttgctcgtgggtcgcaagctgctgaccaccaaggccacctacaagctggttggcctgatcttggtcatggcaggtctggtaaagggtgaagtggtcactggtctcctcgctgagatcgtgtgtgccctcctcgaaggatgcgtgtgacgcaccggctcaattcggtatgcttgtcagcctacctcattgagcagtaagagcaaccctttagggtagtctataggttcctctgtaggctatccaaaggagagctgggtcattaagacagcatagctgtagggttttcattaggatgccctttgagaatatgac

SEQ ID NO: 23 - DNA, 39193 bp, unidentified
  misc_feature 1..11: note = bacteriophages nucleic acid sequence
  source 1..39193: mol_type = genomic DNA
accatcaagccgcaacaccttaaggatagaccatgggagacccatcaagggccaccatcaaggggattgactaagcgatccctgtgctgtattacgtgcgctacgcggtcattaagggccgtataaaccctcacctaaacagagattgttaattcattgaaataagcggttgacactgccgtaaagatgcgtacaatgggccacatcaagacgacacagcgacaacgtagcgacttgatagggtctacccgcccacgctcctaaaggcaccatcaaggcgcccataaagagtccaagccggtgaccagcgccctaagggtgacccataagaccgtcaggcaggatcatcacaacggactgaaataaacgcttgacaatgcaacacaacgctgtagaatgatcgccaacaacgcagcaaactgagtcacctgaacagatgtcatgggtagggtggtgagggtagaggtcaaagtctacgcagcgtggcacgctctttaacaattcggatcgcagcatggcctacagggcaacacttagggccacctgcaagctaccaaggcaagcactgtgccttcctcagcgaccttccaaagagggtcgttagggaatctcataggagcaacacctcatggcaagcatcatcgtatcggcgcatcaacgtaacaacggtagcgactacctcaacgcactgggtctcgctcggcgcacactgaagcacggtaagtcactctcaccggttgacgagatcgcccttaaggtcgcccaagcgtatcacaagtggttgcaagggcacggcaaggacaacaccaaggagacccttgaagagttctatgtgaaccactgcaaggtccgcttggcgaaggatggtaacgaggtgactggtggttacgtggtattgcaccgcgaactgatcggtctcttcagtaaccgcaagggcatgggcgattggctcgtgcaaatggctatcaaggatggcgctgaccatctggactgtttcgacggtcacctgcctgagttctatgcaaagcacggcttccgtgtgcatgaccgggctgcaaactggacaccgggtgaaccggatgtcgtcttcatgaactgctggagcctgtaatcatggcacgtaaagtcacgcagcaagctgtaaacgcattcatcgctggccgcactggggtcttcggtggtaacactgtggtcgaactcagcccactgggcgaggtgctggtgatgaagttgcacggcaacgctatcgcacggcgtgatgtcggccctttcgggacctttgaggtccgtgacggtggctggcaaagcaacaccacaaaggaacgccttaacgggctgcccggtgtgagcgtcaaccaaaagcagtacgtgtggttcctcaacggcgccgcatgggatggacactggacaacgatagcgcagtaaggcaactcgaaaggctctttacggggcctttccggtggcaatacagccaactacggagatccatagcatgaccaacgcaaagcgcaccactcagaccatcaagcacaaaggccgcaagtatctggtcatccacggatcggtaaccttgaagctgctgaagcgcgctggtaagcctcactggtttaccttggaggacggtaaggtcagcgacgtaaagcgtcacaaaggcttctgggaggctctggcagcctacgacaagcgccgcgatgaactcggtctgagtgacggtgcggtcgctgagtcggccactcaccgggcagcggtcgctgagttcctgcaagccgaactggaggtgccagccgatgccaacgcctaaccgctatcagggcaacggacgggcctatcctgaagggaccatcatgggcccgtacatcatgaagggtggccgctggaagcgcctgaaagagcccactccgggcctgtcggacctcatcctgaccagtacgccaagcctaaagggtcctatctggatcggggcgaccatcgcactggtgatcttcgtagctgccttggcggctcttctgcttcgagtgtagttaatcggtggccttcctaagtgagggtcacccgttaaatccactcactggtaacacaaaggaaactgaccatgatctcgctcaattacaccagcttcaccagcccgcaaatcgccgctaagctgctgtcggccatgcacgaagtgaagaccacgggcttcgccgctcggctccacaatcgcaagggagacgccttcctgctggtttgcatcgaaaaggactcgctgggttacgccttcaagttctacgaccgggagggtcgggagatcggcaagatgatccagaaggccagccagcactggtctcaaggtgacttcgcggaatactggtcgggccttgggttcgcttgggacctgaaggagcatccgctgaccattgcagctcgtgaagcctctgagcgggccaatatggacgccttgaaggcacacggggcaacccacaaggtcatcacctacggtggcgctgtggtaggctacggggcctatcaacgggactggctggggcgcaagcgcctctatctggtggcagacaagaacggacgccactacggggtcgccgtgaagatgaccaaggaggctgtactgatggtcgcccgtctggaggtgctggtatgatcctttctgaccctacactggccatttgctctggcgagaagtacgcaccgggcatctgggaagcacgggagatccttgaccagattgaccagtacatggacacctacggcccgatacagcccggcgtggactacgcaccggactccgaatgggccaagttcttcgcggagaacgtgaagatgtacgcaccgggcatctacgccatccgctaccttcacccggagtattgccggaggctgctggtagagctgagcgatgtgcaatacacggtcaacgaagaggaacccgaggacgcccagatacccgaggtcgtccttgaggaacaccactacgggctctatcagtgcctgcgtgggctcttcgagggatacgcaaagaagctggcgtatatcctgatgggtctcgaaacggggcacgctgtgagcattcaggctgcccggtacaccccaacgaacacgccgcatggctgctggcacactgatcgggactctgaggtgacccttgtggttgccctaagcgattcccatcaaggcggtggcactacggtctatcaaggacccttgctgccgcctgtagtcgtcccgcagcttccggtcggctggggtatgctctttgcggggcgcacgaacgaacacatgggactgccggtcacctctggcacccgtaacctactcgtacactggtacgcattggagaagtaacatggcctacaaaccacgcaagatcggcgtttatgacaccaagatcacgaacgataagggcacaggtcgcccggcaccggatgctttcgggtatctctacgggtcccgccaataccgcaaggtcttccttgaggccatggaggttcgacggtccctgccgatccacgcaagtggcgcccacagcttcaccgaccggggcgacttcacgcatctttcggggcgcgggctgtgaggcggcaggttgctcttgtgaaagagccgcccgtaaagctcgtgaagttcaccgccgagcatgtccagatgcacgcctcggggttccacaaggtcgccctaacggccactgagttcaagctggggcttggcccttgcggggagaccgtagagttccttggggtctcggaaagcatcgggtggctgaccatcacacagcgcaccgagaagggcacgaaggacttcaagtaccgggtgcaggacatccgagggagggtcgtcatagaacgcggattttaaaaaccctcacctaaacatagagatccttaagggccctttaaggcctttaaggttactcttagagtaattatcattaagtaatatctttaagtaagagggtttacacagtggcattcattgagaaacaacttcacgacttcgatgacgtgaaaacatcgtgggccttcgagaccctgagcaagctgtacggtgaggatcttgcagcagcccaactggccctcgaacatgaatcccacatgatgggcgaagccaagttccataaggcccttgagcgccaagcggaacgcggtgagttcgcagagacctccgtggctaagccgctggtctccctgctggtccctaagctcgccgctgagctggacgaatggaagcaccaccagatgaccaaggtgcgccgcaagtcggtggccttgaagttcctgaacatggtcgcatctacccgagtggccgccctgactatcaagctggtcatcactgagctggcccgccaacgtgactcgctggcatcggtgaccactcgcattggccgtgtgatcgaagaggaagcccgtttcggtcgcatccgtgacgaagaggccaagcactttcagaagcacatcaaggacgccctgaacaagcgcaatggccacacgtacaagaaagccttcatggaggccgtagaggccaagatgcttgaggctggtgagcttaacggtggctggtcggattggcagaatgaagactcggacatcatgcaccacatcggtgcccggtgcctcgaagcgctcattaagtccaccggtctggtagaactccaccgggtcaatgcgggatctaaggacgatgaacagaccgtccgcctcgcacctgaatggctcgctgagatctccaagcgcaccttcaacctcgctgggatcaacacgatcaaccagccgatggtcgtaccgcctcgcccgtggacccgccctgtaggcggtggttactggggcaagggtcgccgccctactcggttcattcggacccacactaaggctgcccttgagcgctaccgtgacgttgacatgcccgaggtctacaaggccgtcaacctcgcacagaacaccgcatgggcaatcaacaagcccgtgctggaggtcgctaaggccctgctggcgtggcctaacgtgcccatcaagaagtggccgagcgcccaagtctctgagctgccaaccaaaccacacgacatcgacacgaaccctgattccctcaaggcgtggaagaagtcagccgctggggtctaccgtggcgaggccgctcgggtctcccgtaggttgtcccttgagttgaacgtcgagacggccagtaagtttgctgactacgaggcgatctacttcccgcataaccttgactggcgcggtcgtgtgtactccctgacctccttcagcccacaaggcaacgatgtcaccaagggcctcttgcaggcttccaagggtgaaccgattggcgctgagggtatccaatggctgatgatccacggtgcgaacaccgctggtgtcgataaggttcctttcgatgaacgaaaacaatgggtacgcgacaatgaagactgcatcctccgttgcgcaagagacccgcttcagaacacagaatggatgtcaatggattctcccttctgcttccttgccttctgttttgagtgggctggagtatgcgagaatggtgagaaccacgtatccgctctgcccattgcttttgatgggtcttgctcaggcattcaacacttttctgcaatgctccgagacgaaacaggcggtagagcagtcaacctccttccatccgagcgagtgcaggatatctatcgactggtgtccgatggtgttaacgatacgcttagagctgacagtgttgacggaacactggactccacggaggttcacgttgatgagaaaactggtgagatcaccgagcgacgaattctcggaactcgaaccatggcagctcattggcttgctcacggggttgatcgcagcgtcacaaaacgttcggtgatgacccttgcctacggctccaaggaattcggcttctgcgatcaggtccgcgatgacatcgtgcagcctgcgattgacgccgggtccccgaacttcccgaacgcccagcagatgagccgctacatggcacaccttatctgggtctccgtagggaagaccgtagtggctgccgtagaggcgatggaatggctccagaaggccgccaagctgctgtcctctgaggtcaaagacaagaagaccaaggagatcctgaagccagccatgccggtctactgggtgacccctgatgggttccctgtatggcaggagtacaaggtggccgataaggtccgcattgacctgatcttcatgggcgacgttcggttgcagaccacggtccttcaaggcgacaagaaggagaacaagatcgacgcccgcaagcaggagtctgggatctccccgaacttcgtgcatagcctcgacggttcccacctgcgctgcacagtggtccgagccaatgagcattacggcatcgagttcttcgcgctgatccatgatagctttgggaccatccccgcccgtgctggccacctcttcaaggccgttcgggagaccatggtggaatcgtatgagaaccacgatgtgctggctgacttccgtgagcaattcattgaccagcttcacgagacccagatggccaagatgccaccgctgcctaagaagggcacccttcagatccgtgagatcctgaagtctcaatttgcattcgcgtaaaaaccctcaccaaaacgggctccacgaaggggcccacacaggagattcaaaatgaaccgttccaacttcgagcgcatccaatccaccaagccacgtatgccagaagacgccgcagcgatcttcaaggcccgtaaaggcaagcgcaacaagaccgagcgtcacgcccgtcccacttgggactacggcgacaaccacaagaccaacgtaggcgccccgcgtggtcgctatgctggtgaggatttttcctatgcgtaacaccgctgaaatgatcgcaatggcagtcggccacccaactgagcagatcgtcgtggagtggcgggagaacctgcataccatggacatgacgctgtacgtccggcaccgcccgagcaagacccaagtggtcatcaccgggtgcctcttgaggcccatcgagatcaacccagatgaggtcggtatgctgtaccgctacgtcgcccaaccgggccagacagtcgagcttacccacgacatcgctcagaaaaccatccagttcctcaaggagaccgaataatggccgcttccccaatcattctgaaaaccaacccgcaccgcccagtggacttcaaggagtcctcggtggccaagtgcctcgaagagtcgggcaacctgaaccttgaggtcaaggaggacggctgccagttgaacatggtggtccgtcaccagccgaacgctgggcttgggggtactgaggtgtccttcctgagccgtgaaggcaagtccttcaacggccttgacgccctgagcagcaagctatcgaacgacccacgctgggacaagttcttcaaccctcatcttgacggcggcctgttccgtgaaaacggcgggttcctcctgcaagccgagatccttaccttggacgaggccggaaacgtcaagccctgcgctgagatctccggtgacctgcgccgcatggagccgatccctgtggaccagatccgcatcgtgggcttcgacttgatcccgcttgacgctgttcatgcgtccggtgagtacgaggtcttccaagaggtccgcagaggccatttgcagtaccagatcgacggcctgaagaaccgcttccctgagatcaaatggtcgatcattgaggccgtgcaggtattctccttgacccagctcatgcaggtctacgaagagttccgcgtgaagggcaaggaaggtggtgtcgctaaggaccctctgggctactggaagcgcggtaagaaaaccggacagtggaaggtaaagccggatgactcttgcgatggaaccattacgggactcgtatggggcactgaaggtctgggcaatgagggccgcgtgatcggcttcacgatcctgaccgagcatgatgccaccgttgacgcctgtgggctcactgaggcccagaaggacgagttcaccaacaaggtcatcaaggccagcaacgatgcctacgggccgggccagttcggtgacttcggggtcccgtatgtgtccagcgacctgcaaggcgagaccatcaaccccttcgagggttggtccgccaagatcacctacatggaacgcctgccgagcgggtcgtaccgtcaccctaacttcgatcaattccgtgggatcaccgatccacgcatcaaggagtgagcattgtgtctaccgcgatcatcatcgggaccatcgtcaccgcactgggcttgggagcttggtgctacgcaaagtgtaccgccgccgagcgccaagcgggccgcgctgccatcgagaaggctgctgctgaaaaggccgcatctgaaaaggctggccgagaagccaacgaacgtgccaactttaaggtagacgttgcgtccgcctttgaagagctggtcgtgaaccctgactggctccgtggccggtctgacagctacgcctaccgcaagagcttcatggccctgcgcgagttcttcgacaccgtaagccgcctgaagcacgccttggaggcgaaccgccaccttgaggaaaccgtaagggcccaaggcaaggcgttgcgtgagatccgtgcgacccagaaggacatccaacaggccctgcaaatgggtcaaccaatcgagtgacctaacgagccctgctgacttcggtcggtggggcttttttacgtctggaggacttgacatgctgatcgacttcgtgctattcgcactcgtggtccttatcccggcacatgacgtgcttcgatttaaaaaccctcaccaaaacagggacgacactccctgaccttcaacccctcatcaatggagactgcttccgatgaccaataatgtgaccctgctggccctgacctccgtccgtggccgtagcgggaaagacaccttgcttgaacagctcgccctgaccggcctgaagcctgcccgtgtagccttcggggacatcctgaaggaagagtgcgcccgtgacctcgcaacctactggaacgagcccgagaagctgctggactggttccatagcgacatgaaggacgttccacaggcaaccctgcgcatccgtgagctgccagaaggtccgtacaaagagtggctgatgtacaaggccgagcgcccggacccagccgaggactggatgaacgttaaccggaccccgcgctggcaccttcagcagtacggcacgaactaccgccgcaacttcctgaaggaccctgatgtctggctaaatgctggcctgaaggccatcgaagatctcgcctcgctcggtgagaccctgatcgtggtcactgacctgcgccagcgcaacgagtacgtggccttagcgaaacttgccgggcagcttcatacccgtggggtcggcttcaagttcaccaccgtggccaccgtgcgtctgcaccgtatgtggttcgttccgggtgtcgatgacgccagctaccacgtaaccgacttggacctcatcggtcacttcatgaacgccgttgtgctgaaccactggggagacccagcaggcatggtccgtcaactgaaagaacaacttggaggtgccctgtgaacctgttcaagcaaaagatgaaactcttcaaggccgaagtgcatggccaatgggtccctgtatgggcccgtaacgtggatgaagcccttgaggctgccgaactggagtatggtcctgagaacgttggccgagtgcgcccggaggtggcccagtgagtaccgtaacgattcctgagaaggagtatgacgagctgctggccgactccaaccacctgcggatgctcatcaaccgtggcgtggataactgggacggctacgtctcccggcaccacgaagagtgcgatgagtgtggccttgatgaagacgactgcgcctgtggaggtgacgaatgaatctcgcccaaggcggttcccgctccctgcctgacggcttcctgcacatccagaacttcactgtgaccaaggcgtccggtactgctggtatcgtgtggaagctgctggacgaacaccagaaaggggtcgtagagtcgatcctgatcgagcgcgcatgtgccctcgaagaggccgcaggccctgagtggtccaacgcagcgcaccacttcaagcatgacgtgtggcgtttccgtaagaccttccttaagtccaacttttcgttggtcgtagtggagacctgccgaatctgcaagatcgacccggcgaagctgctggctacccagtgggccgagctgcaactttaaaaaccctcaccaaaacagggaggaccttatggttctctctgcaaactcaaaattcctgaaaggagattcaaaatggctgctgcaaaacgtcaagtctacatttcggccaaaggcaaggccgccccttactgcgctatccagaagccggactttggcaccgatgagttcccgcaaccacgcggtgagtacaaggtgaacctgatcgtccccatcaaggacgctcaagctgacatcaagcggatcaccaagatctacgaagagtcctatgcggccttcgtcgaggaacacgaagcgaaccctccgaaggttgctccgggcaagcgtccggtcccagtgcgccaaggcgagctgcccttcttcgaggacggcaacggcaacgtggtgttcaagttcaaatgctacgcctcgtggaagaacccgaagaccgatcagatgcaggacatcaccctgcgtgtggcggacagctccggtaagaccatgagcgtggtcccgaacatcagcggtggctcgactctcaagctgcgctacagcatcttcccgtacaagtggaacaccgctgtaggtgcgagcgtcaagctgcaactggaaggcgtcatgctgattgacctcgttgagttcggcggtggcggtgatgacgattggggcgatgcggtggaagaaggcggctacgtcgctgaagagaccacccaacgtgccgagtgggacgaaggctcccgtggtcatgccgaggaagagattcctgacgctgacgacgacttctgatggctcggggttacgccgggccacgcaatgctcgggtcggtatctaccgatccgggcttgaagagcgtaatgtggcacactgcaagaagttcggtgttgagccgggcttcgagacccactacctgaactacgttgtccccgaaaggaccgcgaagtacaaccccgatctattcctgccaaacgggatcatcgtggagaccaaagggatcttcgagacggctgaccgccagaagcatctactggtccgcgaacagtatcccgagctggacatccgcctcgtgttctcatcgtccaagtcgaagatctattcagggtccaagaccacctacggtgactggtgtgagaagcacgggatcatctacgccgacaagctgattccagcaagttggctcaaggaacccaaaaaggagatccccaagggaatcctaatcaagaaataaggagacccttatggctcgccaagtagcattcaagaagcgtctggtgacggacgccatcgtggtacactgtgccgcaaccaagccgaccatggacatcggtcgtaaagagatccagatgtggcacgttcagcaaggctggctggccattgggtatcactttgtgattcgccgtgacggcaccattgaggaaggccgcccgcatgatgtcgttgggtcccacgtcaagggctacaacgagcgcactctgggcatctgccttgtgggcggtatcgacaccaagggcaaccctgaagacaacttcacggaccaccagaaggccgccttgcagaccctgctgtggcgcatgacttccggtaaggactttgagggtgcctatcaggatctccctgtggttggtcaccgtgaccttgatccccgtaaagcctgcccgagcttcgacgtgaaggcatggtgggaatcccgcaaggaataaaaaccctcaccaaaacggggcccactgtggccctgttccccaaacgacaaaggagactgcttccatgtctgtaaatcgtgaccaagtgatccgcgcactgagcatcgcggaagagctgagcgcccacgggttctctgtggccatcgctggtggcttctgccgtgatgtgtactttggggtcgccccgaaggacatcgacatcgttgtggcctctgggtctatccacgatgatcgaaccgaagcccatgaaatgctgggtgaggtcctgcgccaactgggagtcgaacacctcggcttccgcatgtacaacgagaacaccagtgatcgcatcatcggtggcttcaaggccgtagggaatctggatgtcgtcctgtacgatgtcaagcacgcccatgaggctgtcgatgcgttcgacttcaatctgaaccagttcgtcctacagcgccgtgaggacttcgagaccgcctatgtggtctacgccggggacacctcgtggcacgaactgacaccagtccgtaaggatttctccgagtcccgccgtagccgcatgatggagaagttttttgacctcgccagtcgttaccctgaaggtggcggcccggcccgcgtaggcctcgcacaggcctttcgtaaggagtgatctatgagtgaccgtgaggaagaaagcgtcctgttgcacaagggaccctgtgagcattgtgggtcatcggatgcccgagcggtttactctgatggccacagcttctgctatgcgtgccctgagaacaccgcatggaacgcaggggatggctatgtgggctccgaaaagaaggccaccaaggcccatgctgacacactgaacttcgcaagcaagcagggccgttacagcgcccttaacgcccgaggcatcatggtcgatgtctgtaagcagtacggctactggctcggcaccttcaacggtgagaccaagcaggtggccaactactacgacaccagcggtaacctcgtggcccagaaggtgcgcgaccgtaccaaggacttctttgtggctggtgacatgcccaaggatgccctgttcggcaagcagctctggaactccggcaagaagatcatcgtcaccgaaggcgagatcgactgcctgaccgttgcccagttgcaaggtggcaagtacccggtcgtctccatccctcggggtgccaaggacgccaagaagacctgctctgcgaactacgcctactttgaccagttcgagaccatcattctgatgttcgacatggacgaggatgggcgtaaagcctcccaagaggccgctgaggtactgcctccgggcaaggtgcgaatcgctgtgcttcccctcaaggacgccaacgagtgccttctgaacgggcagtccaaggcggttctcgatcaggtgtggaacgcgcaaccttacgtccccgatggggtcgtctctgcgaagtcgctcaagcagcgcatcaaggaaaagaaggttgtcgcctcgatgcccttagtgggtcctttcgagctgcgcaagatgaccaaggagatccgcgaaggcgaggtcattctggtcacctcgggtagcggctccggtaagtccaccttcgtgcgccaaaacacccacaacctgttccgcaattcgggaatccctgtgggcgtggcgatgcttgaagagtccgtagaggaaaccgtgcaggacatcgtgggcctcgaaatgggcgtgcgtgttcggcaggagcctaacgactacaccgaagaggacttcgacaaggccttcgatgagatcttcgagtccaacctactgcacctttatgatgcctttgcggagtccgctgaggatcgcctgctggcgcgtctggcctacatggtggacgtagagggctgcaaggtgatcgtgctggaccacatcagcatcgtggtctctgcgatggacggcgagaacgatgagcggaagatgattgaccgcttgatgaccaagctgaagaccttcgccaagaccaagaacgtggccgtgttcgttatctgccacctgaagaaccccgacaagggcaagcctcacgaagagggtcgcccagtcaccgctacagaccttcgtggctctggcggcctgcgtcagttgagtgacaccatcattgccgttgagcgtaaccagcaaggggacaacccgaacctgatccgcttcaggctgctgaagtgccgcttcactggtgagacaggcatcgccgggtacatggagtatgatcgcaagaccggtcgattggtcgccaagcctgaaggctggaagccgaaagacgacgatgacggttcctcccagtggaaggaatcccaagcccaagaagaagaggacttttaatcatgcgtaaagtaaccatcaagttcgacatcgttaccgctctgatccaactggctggccgcattcaggttcgccgtgtgaagcgtgcagagagccgtgcagaggccgcagcagcagccgttaaggccactgaggcagccctgaagctggcccatgaggcagccgccaaggcccgtaccgatgccaccaccgagaagttccgagtccaccgcgacccaaacatcgtggtcatcgcacccgtgaccgtgaagtgatccaagggcgtccctcgtgggcgcctttcagtcaactcactgccaccctgaaaggagatacctatggacaaccaactgattcgcgcacacctgcgtcagggtgagcaggccgttaagaccctgcaagccctcggctacacctacgagcgtggccactgggtcgccccaacgagcccacacgatcccctgctggccgcccttaaggagctggtagaggctgaggtggtcaagcgtacaccaccacctgcggacaccaacctgaaggcaggtgacgagttcgtcatcaaccgcataccggtgaccgcaaacgcactggctgcccaaccgtgggaaggccggatcttcaaggcccgcgaggtcgagatctcccgtgagcggggcatcgagatcgtccgcttcggcttcaactttgggaatcggggcttctggattccgacctcccacgtaacgaaggtgacacgacatgctgatttctgacatcgaggcgaacggcctcttagaccaccctgacctacggttccactgtggagtcaccgaggacgccttcacgggcgaggtcattgagtaccgcccagatgacgtgctggcctacatcaaggccctcgaagcagaagcagcgaagcctgatggtctgttggtcttccacaacgggatcaagtacgacatcccggccctcgacaagatcaagcgcaagctgaccggtaagcgcctcaacgtgccccgtaagcgcgtgctggataccttggtgctgtcccgcctgatccacacgaacctcaaggacaccgacagtggcctgctgcgccgtgggattctgccgggcaagcgctatggctcccactcgctggaagcatggggttaccgcctcggtgaaatgaagggcgagtacaaggacgacttcaaggccaagtgtcttgaggacgggaccgagtacgtggacggcatggagtgggccaacttcaacgagcccatgatggcgtactgtgtacaggacgttcgcgtcaccgtgaagctgatgcgccacctgatgcaggaccagtattacttcagcgcccctcaaggcatccgtgcggttcgcattgagcatgacgcggcgtggacgctcgccaagatggagcgcaacgggttccccttcaacaaggagaaggccgaacagctctacatgacgctggccgctgaacgctctgacctcctgattaagctcgtgaagaccttcgggtcttggtatgagcccaagggcggtaacgagccgttcctgcacccgaagaccggtaaggtcctctcgaagtacccgatggtcaagaccgcaaaggctggctcaccggactacaatgcggatggcaaaacgaagtccaagacgctgtacgtcaagggctgccagtacaccccggtggagcacgtaacgttccagccgaccagtcgcccgaacatcatcaaggtcctgaaggacgccggatgggaacctacagagttcaccgagaagggcgccccgattgtggacgacgagacccttgagggtgtccttgtagatgacccggtgaagcaggagtgtatcgccctgatccaacgctacctgatgatccagaaacggatcggccagttggctgaaggtgacaaggcgtggctccgttactgcgagaccgaggacggcttcattcatggctcgatcaatcctaacggtgccgtaacgggccgtgcgacccactcgttccccaacatgggtcaggtcccttcctgcggtgccccgttcggtcctgagtgccgtgagctgttcggtgctgagtgggcgaagcacatccccggatggcataacgtcaagcaggttggtgtggacgccagcggccttgagctgcgctgtctgggccacttcggtgctcgtttcgataagggcgcctatgtggatcaggtccttaacggtgacgttcactgggccaacgcactggctgcgggcattgcacctgctggtctggtccgtgataaggccaacaaggagcatgacgggttccgtgataaggccaagacgttcatttatgcgttcctctatggcgctggtgacgctaagattggttctatcgtgggaggtggagcggctgccggtaaggaactcaagaagtccttcttggagaacacgccggtcattgcgagcctccgtgagtccatcgaaatgtccctgatcgagtcgcagaccttcaacaaggtgacccgtaagttcgacatcaagtggaagcgccgatggatcaagggcctcgacggtcgcaagatccacgttcggtctgcccacagtgccctcaatgcgctccttcagagtgccggtgcggtcatctgcaaggcatgggtgatcgaggtagagcgaatccttatggaggaacacggcctgaagcacggttggaccatccacaacgatgacgggaccaccacgccgggcgacttcgccttcatggcttgggttcacgatgaacttcagatcgctgcacgaaccccggagatcggggaacttatcatcaaggtctcgcaagaggctatcagaaacgtaggcgagtctttcgacttcaggtgccagttggacaccgaagggaagatgggccccacatggcgcgagtgccactaaggagacactaatggctaagaccctgaaagcaaacgtatcgttcggcctgacctgcgtggtcaacactgatgccgagaaggccctcgaagctgcccgtgacttggcccgcgtggcccttaagcacggcgaggcaccgaagggtgagcaaggggcgatgctgtccctgttcgcctctgagaagcccactgaagagcttctggagatcatcatccgcaagggtgtacgtgaactggtccgtgaagagctggaccgtgagctgaacaccgatgagacccgagcaaccatcgggaacatcaaggttgactttgaggtgcgtgaatgaatgaatacctgaacgtcctgtgggcggtcaaaaagcaggcgcagagttaccagtctgactacgtgcggaagcacatcaagctggtcaacgaagcatcgagccgggggcacatttcgtgcctctcgactgccggtaagaacatggggtattggtccctgacaactgaagggcagaacttcctgtccacctacggaggtgctgtatgactctgcgtatcggactcgcactcgatatggactacctgatttattccagcatgtcagcctctgaggttgaacaggactggggtgatgatgtgtggacccttgagtgcgaccatgccaaggcccgttcgatcctgttcgggaccatcaagaccctcaagaaggacatcgtgaagcagcttgagaagcgctggccgaagctgaaggccaaaggtgcctacgagctggtggaactctgcgtcatcaccggaaagggcaacttccgtatggacgtgctggagtcctacaagggcaaccgtgtgaccaagcgcaagccagtgggctacccggccttctgccaagccatgatggaccacttcggtcctgaccattcgttccgtatcgacggtatcgagggtgacgatgtgctgggcattctggccaccaaccctgctatggcgaagtgtgatcgggtcataatggtgtcctgtgacaaggacttcaacacgatccccggagacttcttctggctgaccccgatggaactcatccgaaacgatgaggcagccgctgataagtggcacatgcgtcagaccttgatgggtgacaccaccgatggctatggtggcgtgccgggcgtaggtgaggcctttgagggctccctgatggactggctggacaatcccaagttctacgagaagaccaccaagatcatgtcccgtggcccccgtaagggccaagaggtgatcgagtgggtgggccgtgcgcctgccgaaggtgagactctgtgggactgcatggtctcgctggccgcctcgaaaggcatgtcggaagatgaccttctggtgcaggcgcgatgcgctcgcatcttgcgggcatctgactggaacgccgagaaacaggagccgatcctgtggacacctaagcgctaaccactgtagggcttccgggtggggactctaaaaaaccctcacctaaacagggagccctatggggtgaaacccttaatacttaaagaccactcaaaggagggcctatgctgaaagagattcaacacttcattgaccatcctgatgacatccctgacatccctgatgcgtccgcacagttccttaaggtccgccttaacccggcctatctgatgcgcacaggcgtcacggatgacctgacgaaagctgggtggtctgaaggaaaaatcatggggttccttgaaggctgtgcgtctgtagtcgaactgatcgaactgatgcaggaagcccgagtgaaccctcaacaggaggacttgggcaatgtgcttcagtaagaagatgaaaatccctaagcccaacacggaccaaaaggctcccgagccggtcctgttagaggccccgaagggtgttgcgttcggtgacggcgcagacgatgaggtgaccaatgacgatgctcaaagctccaaaggcatcgggtcgctgaaggtcaagaaggctgatgtggacactggtgacggttcccgcactgctgcacccgttaaagacaccggcattacgccatccaaaaagaacggctccattaagcgggccatgaagcgataggaggtccatatgggctttggcaagaaactcaagaaggcgttcaagaaggtcaccaaggtggtcaccaaggttgctgatacggccactggtggcgctgtaggcggtctgctgggtggtggtaacgaagagaagcccactcaggtagtggaggcaccacctcaagtcaccgcaccggcaccgccccagatgcttcagaccaccactgaggtcgccaagaaggagaccgagggcgaagacgactcggataccgaagcggccaagaaggcagctcgccgtggcggcaagaagaacctgagtgtggcccgttcgagcggcaccggtatcaacatctgaccagcgaggtgacccatggctgagacccgtcaagggctggccgaggaaggcgcaaaggcggtctatgatcgtctgaagtctgatcgggcaccctacgagacccgtgcagagaactgcgccaaggtcacgatcccgtccctcttccccaaagagtcggacaacagctccacgaactacaccacaccgtaccaagcggtaggtgcccgtggggtcaacaacttggcagcgaaggtccaccttgcgctgttcccgctcgaaccgtggatgaagctgaaggtctccgaatggcaggccaagcagctcgtaacgaaccctgaagaactcgcaatggttgagcagggtctgtccatggttgagcggatcttgatgagctacatggaagctaacagctaccgaacgacccttcacgagctgatccgccaactggtgatcgccgggtctggcctgctgttcctgccgccacctgaaagttcctctcaaggttccccgatgaagctctatacgttgcacaaccacgttgtccagcgcgatgccttcgggaacgtcctacagatcgtgacgctcgacaaggtggcctttgcggccctccctgaagacgttaggtccaagctggacggtgaccatctgcctgacgaagagatcgaggtgtacacccatgtgtaccttgacgatgagtctggcgactacctgagctatcaggagatcgacggcgaggaagtggaaggcaccgatggtcagtaccctcgtgatgccatgccgtggatcgctgtacgctggaccaagcgcgatggcgagcactatggccgctcccacgtcgaagagtaccaaggggacctcgattcccttgagaacctgcacgaggccatgattaagttctcgatgatcgcctcgaaggttgtcggccttgtgaaccctaatgggatcactcaggtccgccgcctcaccaaggcccagacaggcgcgttcgttccgggccgcaaagctgacatcgagttcttgcagttggacaaagcggctgactttacggtcgccaaatccgtggccgatgccattgagggccgactgtcctacgtcttcatgctgaacagtgcggtacagcgcaatggtgaacgtgtgaccgccgaagagattcggtatgttgcccgtgagctggaggacaccttgggcggggtctattcgatcctgtctcaggaactccaactgcccctcgtgcgcatcctgctgaaccagctacaggccacccagcagatccctgatatgcccaaagaggccgtagagccgaccgtaagtaccggtgtggaagcactgggccgtggtcaggacctcgacaagctgacccagttcctcaacgcgatgacccttgtggcgccgttggagcaggatcaggacctcaacgtggcgaccatcaagatccgcttggcgaacgccatgggcctcgatacgtccggcctactgttgactcaggaagagaaggcgcaacgtcaggccgaaatgatggctcagaccggtggcgagaaccttgcagcctctgcgggtgctggcgctggtgccatgatgacacaagaccctgacaccatggagtccgctatggacaccgctggggtcgctgtacctcaagtgtaaaaaccctcacctaaacggggagtgccgctgtggcctccctgttcaccctaaaggagacccaaatgtccaatgaatcccaagccgatgtgtacgcttcctttggcgtgaacaccgctgtattgtccggtgacaacatcgaagaacaccgccagtccatgctggaactcgatgtggctgcccgtgatggtgacgattccatcgagctgtccggtgagtccgccaacgttcaggtcactgaccatgtggccgatgagctgaacaccgaagacaagatcgaagtcaacgtgccgaccgaaggcgagttcaacgaggcggtcaccgaggaaggtggcgaagaaggctcgaacgaacccggtgaagacttcacgcctctgggcgacatccctgacgagctgcaagctgcctcgactcagatcaccgaccacgccaatggcttccgcgaaatgcgcgaacaggccatcgccaaaggtctgagtgaagaggttgcggcccagatcgaagctgaatacgaagacgatggcgagctgtccgaggcgtcccttaaggcgctcgaagaggccggtttcggtcgtaacttcgttcaggcctacatccgtggacaagagtcccttgcggaacagtacgtggccaatgtgatcgcctttgcgggtggtcaacagagctttgaacgtgtggtccaacacatgaccgccaatgcgcctgacgctctggaagcccttgaggcagccattcagcgccaagacattgcctcggtgaagaccatcatcaacctgtcgatagccagccataccaagaagttcggtaaggcacctgctcgttccatcaccaaggcggcccctgcgagcgccccacgagcccaacgtgctcaggtggaaggcttcaagaacaccgatgctatggtgaaggccatgagtgaccgccgttactctaccgatccgagctaccgtgcagccgttcaggcccgtgtagctgcatctaactggtgacgatttaaaaaccctcacctaaacagggaggaccatttcggttcctctctgatccctttctgatttacataaggagattcacatggcgaatatgcaaggcggtcaacagattggtaaggaccaaggtaagggccaatccaacgcggataaactggcgctgttcctgaaggtcttcggtggcgaagtcctgaccgcattcaagcgacgttccgtcaccatggacaaacacatggtccgcaccatccagtccggtaagtccgcacagttccctgtgatgggccgtaccgctggcttctacctcgctccgggcgagaacattgatgacaagcaaggtgacatcaagcacaccgagaaggtcatcaccatcgacggcctgctggtctccgccgtgatgatctacgacatcgaagacgcaatgaaccactacgatgtgtcgagcgaatactcggcccagttgggtgaggctctggcgatctccgctgacggtgctgtgctggctgaaatggccaagctgtgcaacctcgctgctggcaaggacgagaacatcgaaggtctgggcaaggccgaggtcctgccaattggtaaggctgatgacctgaccgacccggaagcccgtggcaaggctatcctgaagggtctgactctggcccgtgccaagctgaccaagaactacgttccggcctcggatcgcttcttctacaccagccctgaagactactcggcaatcctcgctgcactgatgccgaacgctgccaactacgctgcgctgatcgaccctgaaaccggcaacatccgcaacgtgatgggcttcaccgtggtcgaagttccacacctgaccgtaggtggctcgggcgatgacctcgctggtgccaaccgcaagcacgccttcccggccagctcgggtggcgatgtccgtgtggccgctgacaacatcgttggcctgttcaaccaccgctcggctgttggtactgtgaagctgaaggacatggctctggagcgttcgcgccgtgccaactaccaaggtgaccagatcatcggcaagtacgcgatgggtcacggcggtctgcgtcctgaagctgctggcgccttggtggtagaaaaggcgtaagcgtaccggacccgactgggtaacgctgagtcagaagacaatggcacttgatgtagggcttctaaggcccttacagccactgttctaccagtaggagcaccacaggcggttgtctggcagtcgcaggacgaacaagtcgctaaggtatcccttgaaggtctcgtagaggcaatcggagcgggaacttgcgatgtcacggcgactaccctgaacggtatctctgcggtatgcaaggtaaccgtaagggcgaccgaaccgtaacactcaaaccccttggggcccacctcgggtcttgaggggtttttttcgacttcccataaggagggcctatgcgctcttatgaagcaaccttggagtccccggaagagctggccgctgtgaatgacatgctggccgctatcggtgaggcccctgtgagttcccttgagggggacatgaacgctgacgtatcgaacgcccggcgtatcctcaacaacgtgaaccgggaggtgcagtccctcgggtggaccttcaacatcgttgagggcgaacagctcatgcctgacgccttcagtgggttcatcccctacatgtccgactacctgcgcatgactgccggtggtgggaccccgtatgttcgtcgtggtgagaacgtctatgacaagaccaacaagacggatgtcttcgcgggtcccattacggtggacctgatccgccttaaggactactcggaaatgcctgagtgcttccgtgcgtggatcgtggcgaaggcttccagacgcttcaatatgttcttcttcggtgcaggtgagatcgaagggcacttgcaggcgcaagaggacgaggcataccgggcctgtatggagtacgagctggacttcggtgacttcaacatgctggacggcgacgtgttcgttcagggcaaaatcaaccgataaggaggtgactatgggtctggtaagccagtccgtaaagaacctgaagggtggcatcagccaacagccggacatcctccggttccccaatcagggtgcgcaacaaatcaacggctggtcaagcgagacccaaggtctccaaaagcgacctccgagtaccttcgttaagagactgggagtgaccggtatgtggggcgctaagcctctggtccacttggtgaaccgagacgccgttgagcaatactacatggtcttcacaggaaccggcgtggccgtgatggaccttaaagggaaccagtacacggtgcgtggctatgacggctatgcaaactgtgcggacccacgagccgaccttcgcctcattaccgtggccgactacaccttcgtggtgaacaggcggaccactgtggggatgtccggtgagctgacccatgcgggctatcggaacctgaacactcgggctgtggttgcctgccgtggcggccagtacgggcgaaccgtgaccgtagaggtcctgatcgacgttacgtgggtgaagctcgctgagctgaagctgccatccggtgtaggtgagcctggccagatcgagcccatggtggctcaggtggacgcccagaacatgatccgtgcgatggtggatcaggtaaacgtcaatggtgccccatggaaaatcactgctggtgagtacgcaggctgtatgctgcttcaccgggatgacggtggaatcttcaacgggattcgcaccaaggatggctatgcggaccagctcatcaacggcttcatctatcaggtccagtcgttcaataagctgcctgctcaggctcctgaaggttacctcgtggagatcaccggggaagccacacgctcgggagacaactactgggtccgttacgatggggcccagagggtctggaaggagaccgttaagccggggatcattgcgggcctgaaccccgtgaccatgccccgaggtctcgtaagggctgccgatgggcagttcgactggaaggtacttgagtgggccaaaaggaacgctggggatgacgagacgaaccctatgccctccttcgtggatggtacgatcaatgacgtgttcttcttcaggaaccgactcggcttcctcagtggcgagaacgtcatcatgtcgagggcttcccgttacttcaacttcttcccgccgtccgttgcgagcctttcggatgatgaccctctggacatcgccgtgagccacaaccggatctcgatcctgaagtatgccgtaccgttctccgaacagttgctgctgtggtctgaccaagctcagttcgtgctgtcctcgcagggcatcctgtcgccaaagacggtagagctgaacctgaccactgagttcgacgtacaggacacggcccggcctttcggtatcggtcgcggggtgtacttcagcgccccacgggcagcctatacgagcctcaagcggtactacgctgtgcaggacgtatcggacgtgaagaacgccgaggacgtatccgcccacgttccgagctacatcgagaaccgggtgtttaacatccacggatcggggaccgagaactacgtcaccctcctgtcggatggggccagtgaccggatctacatctacaagttcctgtacatggccgaagagatcgcgcagcaggcgtggagccattgggagttcggcaaggccaacatcctcgcctgtgcctcaatcgggtcctacatgtacctcctgctggaccgccctgaaggggtcgtactggagcgtctggagttcacggcgtacaccaaggacttcccacaggagccttaccggacctacatggactcgaaggtatccgtggtgtgtagctcgttcgatgaggacaccttcaggtccgctatgagccttcagttgatctacggtggcatccccagccatgactcgatcttctggtcaatcgacacgcaaggtgttgcgacccttcacgagcccccagcgggcgggtgggcggctgactccaacatctaccttcagggagaccacaggggcaagacgttcatcatcgggcggcagtacacgttcatctacgagttctcgaagttcctcatcaagcagactgcggacgatggcactacagccaccgaggacatcgggcgcttgcagcttcgccgtgcgtggctcaactatgaacgctcgggtgccttcgagatctccgtacacacgggggacccggagaaggcgtatgtgtacaccatggcaggtggccgacttggctctgaggtgatcctcggtgagctgaacctcagcactggtcagtacaagttccctgtgacaggtaacgccatgcgccagatcgttaccatcgccagcgacaccccgaaccccctcaacgtgatcgggtgcggctacgaaggcaactacgtgcgccgttccagcggcatttaaaaccctcaccacaacaggaggcttcaatgatcctaacccaaaccacaccggacatgctcgaagaggcggcccgtttcgtctcccttaatgaccgggaagagttcaacaagatgcaagcgggtcgggaccttgaggccacccttaagaagtcattgggtccgacctcaatgtccatcatccacaatggccgcgtactggccacgggaggctccaatgagtgcctgtggttcatcacgacccgttgggtggaagagctgaccccaaaggagcgcttgcagatgctgcgcctcctgaaggaccacttggagtattgccgttcggtgatgcctcctgaccagctcagtaacttcgtgtacgaacacaaccatgctcaccggaaactgctggacgcccttggggcccgttatgggttctatcaggagtacagcccggctgggttcccattccgtcaattctggctataggaggtcgctatgtgcgaaccggtatccattatgatggccgtgggtgctgctgctggtctcgccagcggggccatgggtgccaagcaacaagccaaggctgaaggtgcagccgaggatgctcgacgggccaatggtcacgagcagatccttgcaatgcaccgggccgatgctgacatgaacttggagacccaagacaagcaccttgaagcccgtagccagctcaccgagacgaacttgacagccctgcgcaaccgtgggactgtccgggccgctatcgctgagtcgggtatggagggtaacaccatggaccgtgtacagcgggacgtggagaaccaagcaagccatgagaagatggcgatcctcgacaactacgaacgcgactacgcgacgatcttccagaataaggtcgccaacgtggagaacaccaaggcagcccttcgggggtcccgttcagcggtcggtacgtcgaagctcgctcaggccctcaacgtcgccagttctaccctttcgggggccagtgcgggtgccgctatgggctcccaatacaaatccgctacagccaaataaggaggtcatatggccaacccactcgctcaatcactcggaggccttgagggctaccgtgggacgaccctcaaagagaagggcccggtccagtcggttggccctgccacccacacagctcgcaatctggacaacggtctggcaaacgcaatgcgcaacttcgtgcagaccggtgcggacgcttacaaccagtacgatcagcaccaacagaagctggccgaagagcgctccaatgagatcatccgaaagctgacccctgagcagcgccgtgaggcaatcgccaacggcaccctgctgtacaaggacgatgcccgagcgatgaccctgctgcgtcagaagactggccgtaacgctgcgttcgaggtggacagtgagatccaagccaagatccaagcaggccacttccgcaaccgtgaggacatggaagcgtaccgccagcagcgaatggccgaccgagccaagtcctacgccgaatcggcagggatcaacccggaggaccctgactaccagcgcgggttcaacaccgacatcgttcagcgcaatgctggcctctacgacctgcacagccagttcctgtcgaagaaccttgaggcccaagcgtccattgaggcccgcaatgacctgaccccactgatgaacgatccgaagttcctcgggtcccgagacggggcctatgtggtggccaactacgtcaacaagggtctggagacgggcgagttccccagcgaccgtgaggcgatcaatgcgatcaccatgctgaccggggacgctatcgccaaggatggtggacaggtgttcctgcgggaactgaaggacaagaagatcaaggtactcggcggggagaccactgtggagaaccttctgggtcctgaagtctaccagcagatgctcaccaaggccgatacggcgcactatgagcggaacgccaagaagaccgaaaacctcatgctgggcattgcgaatgcgcaggctcaggaagacccagcggctggctggcagttgctcaaccgactcgaacaggagaacgattgggtccagactggcgaccagatgacccctcaaaggcaggcactgattcaggccaaagcccagatgatcgaagcggtgaagcggcaaaccgctcaggcccaagtggctctggacaagcgggctcaggccgacaaccgtcagctaaccatcgacaaggcctatgaggcccggatggccggtgagtccgtttcggtggaccctaagttcctcccgagcgatgacgatagcggaaagttcacagatgcggacatggccaactacgcccacaagaagatgctccagatcgacaaccttggggtccctgatgaccagaaggctcgaatgaagctggccctgctgaaggcggactacaaggatggtccgttccaagcagccttccagacgctcacacaggacgccgcacaggagtggcaggcagccttgattcaaggtaagcccggtgacttcaagcgcctgtacgagctgcaacgggcctacaaccagaaccccggcatacttgcccagctctaccctgagtccgctggcctgatggagaccctgaagtttatgggtgccaatgggcttgatcctcagatcctgatcgacgctgagcggaacaagccgaagactgaagaggaacggcgttaccgtgaagagcagtgggccgcaatcaagaacgactcggccacagcagacatcctcaagtacatccctgatgacatggagaagatggcccgttccgtcttcgatgcgtacaccacgcacaccgggtcgtcctcggatgcctccaaggctgtcactgagttccttcaaaagaacaccgtaacgttcaccgagaagtccggcacctacgggttccgctctacggcgttccacgggatgctcaccaagaacgaccttatggtggacccaaacaacaccgactcatgggagaccggtaaggccatcatcgacacggccatgcaagaccttcagaaggactccgtatggggcgcctctgggatgtccgtgcatagccgcgatggtctcatcgtgatccagaacatgaccggttcccgtctgaccatcagcaaggaccaactggccgcattggcagcagagcgtcagcaggctgagcagcaggaacgaatcgacaaggctaaggccgaaacccaacgcacccagaagcagtacgacaagtacatgcggggaggtgcccaatacccaaggagatcattatgagctttgagaaagaatatgcagccgtcaaggctaaaggctccatctatgatgcgagcatccaacgtgcagcagaggcccatggcgtgagctatgacttcctgcacaagcaactgttcatggagtcccgtttcgatcccaaggctcgctccaagaccggcccccgtggcatcggtcagttcaccacagcaacagggcgggcctacgggctcgtcactgaggaagacttctttgaccctgagaagtccattgacgccgctgcgcgtcacctcaaggacaacctgacggcctctaacggggactaccttcaggcagcccttctgtacaatcagggcggtggccgtctgggtcgcccacaagtagccgctctgcaacagggcgatgccagcaagatcagccacgaagggatgctctacatgcgcaacctcgcagacgtggccggtgattctcccttcaaggctcttctggggaccggtgtgaccaatccgggcatttccccaaaggctgaggcagtcagctttgaggacgccaccaagggcgtggctgccagctccaaggtgcaacgtggcgtcactcctgaaatgggcaacatgaacgtgcgtggcggtgaactcaccgagacccgtacaccgttcgcccaattggagtttgacaccaaggctgccccaaagggctggttcgagggaacaggccaagcggtcaagtctgagctggccactggcaccttgggtcaactgttccgaaacgtcaccatggaaaccttcgatccaatggaaggctacgagaccccggacaccagtgcgtgggacgacgagaccttcgacaagatccgcaaggctggggtagacccacagttctacaacttcctgttcgatcacacccgtggcaacaagaaccgccttgactctgcgatcaagctggctaaggagaacatggagcatcaggctaagatccgttcggcctcgacgagtgcccagatcgttgcgggcttcgcgggtgcagtgactgatccgttcacctatgcacctcttccgggcgcccaaggtgccaccctgttctcgaaggtggtgtccggtgcagtaggctcaggggttgccgcaatggcatccgaaggtctccgtgaagcatcaaccggcatggaagcccactacgctaccgctctggttggcggtgctctcgttggcggtggactgaccgcattggctgaccgcattggccgtgcagctcgccctgagccccgactggacatgtgggacactgacctcgaaagggtccttgcgatgcacggcgaggctgccctgccgaatgagttccatggtccaagcgtccgacttgaggcacgcgaaacggcccgtcaaggtgactttgaggaccccactcggatgccgtggcaggcacatgaacaggtagagaacttcgctggtctggacttcgttcgccacccaaccgagcaaggcgctgtacgcctacctgacgggtccgtgctgagcgctgggaacccgctgaatccgctgaccattcagcagttccgtgaggctgagcgcgcagctccgggcgtatccatgggaggattcactgagatcggctacacactgacccgtagcgagaacgaggatattcgcaacatcggtgcggaactcttcaggtctcccacagggaccgtatcgggctcccacgggaagttcggtagcaccgcctcggacatcgttgagcgtatcggtgcgcaggaccatgtgagctacaacaacattgtctctgcggcacatgaggcaatcaaggacatccgctacaagtccatggagggtggccgccaagcccagttcgaggcagcgtatcgtcgcgtagtggaagccattgaggacaccacaggtggccgtgcaaaaggcctcacgactggcgagaagaccctcatggatgccttgacggcacactacagccgcaagctggatgccctgcaaaacccagctcagttcggtaactaccgggcgacttcagtcctcggtgcgacccgccacgaaggtcactacatccccaacgtctacgatgatggggccaagaacctgtgggcctcccgtctgggaggtaacgatggcctgcaacaggcgatcatggaaagctggctggtgtcctacgcatcccgccctgccgttaaggctcgtgtggacaagatgattctggacgccaatccgggcaagaagatgacccctcgggagcttcaggatgctgtcgaagagtacgcccgtaacaaggcctatggcataagccacactcaggacttcaaccgctcccacttggttgacgatcagttgaccggtctggttggcgctgagaacaacaacttccttgaggggcgccacctgttcgactcggacatgcagatcgacattggcaatggccagatgttctcggtcaacgaccttcggaacttcgacatgacccacatcaccccaaactacgaccgccgcgtcaacggtgacatcgggatcatgggcgcaactggtcaatccactgaggcccttaaggaccgcatcacagctcttggtgtgggcatggagaaccggaaggagtacaaggcgcttcaagatggcctgaagatcctgaccggtcgggcccgtagggaccctgatggtgtcatggcgacccttgcacgggcagtaacggacatgtcgttcctcgccaagaacgcctatatgggcattcagggcatcacggagaccgctgcactggtcaccaaggggcacactcggctgcttatgaagggtgttccgttcttcaaagagatcgccaccatgggatcgaaggctacccctgagttccttaacgacatgcacggccttgtctttggtcgcgagctggacaacctgatccgaccaacccgccaagatatcatcatgcgccttcgtgacaacgctgacgcctccccgatggtggcaaaggctgtggggaccctcaagttcatgactggtgaagcctcggcccgctggcctatgacgaagttcctcactgagtcgtccaactacatcgctgacgcaggccgccaaggtatgctgaaggagctggtggacttcgcgcatggctccccaagccgtatgggcaagaagctgttcaacagcgaacgcctgaagtccatgtccctgactcaggagcagttcgacggtatcgttcaactggtcaagcagaacacccgtgtggtggatggcaaggcccagatcgttaaccgcgaagcgttccaaagtgacccacggtcgatggacctgtggcgactcggtgacaagatcgctgacgagaccattctgcgcccacacaagctgtcgtctcaggacaccaaggcttacggcgctggggtcaagctggcgatgcagttcaagaacttcaccatgcgctcgatgaacgctcgggcaatccgtgcgtaccacgatgccaccaagaatggccgagctgctgatgcagtgatgcaagctgtgatctctaccggtatggccggggcaatgttcgccgcaatggcttacacccgatccgtagggatgcccgataaggaccgcgagaagtacctgaaggacgccctgaacccgaacatgctggcctacgcggcgctgtcccgtgggtcccacattggggctcctttgggtctggccaacatggtcgctgcccctctgggattcgatcaggcccgtatggtccgcacgtcgatcactccacgtcccaagcaggagaaggacaaaggggcaatcaaatacggcgcctctaaggatgaccgtgtgcaggacatgatgtctggcgtactggaccaagtaccgggcgcctcgtgggtactgtctgcgggccaagcggctcactctgcggttggcttggcgggctccagtgggcgccgtcaggaccaagagtacatgacgagcctctacaatggactccgtggtatcatccctaacgatccggccagccagttcatcctgatgaagatcatggaggaacagggcatcgaagctcgctgataaaaaccctcacctaaacaggggcgctaccacaggccccatcactttgaccgtaaggaggccctatggctacagcaccaaagactacggtcacctacaacctgaacgggaccgacagggacttccagatccctttcgagtaccttgcccgtaagtttgtgcaggtgaccctcgtgggcgtggaccgcaaggtccttaccctgaacatcgactatcggttcactcaacggacgatcatcacgaccaccaaagggtggggacctgctgatggctatcagttgatcgagatccgtcgatatacgtccgcaaccgaacgtctcgtggacttcagtgatggttccatcctgcgtgcatacgacctcaacaccgctcaagtccaatcccttcacatcgctgaagagggtcgtgacatcgccaccgataccatcggggtgaacaatgacggtgaccttgatgcccgtggccgcaagatcgtgaacgttgccgatggtacgagcgacttcgatgctgtcaacctccgacagcagcgcgtgtgggcaggctcagcaatgaaccaagcagaccgagccaagtctgaggcagaccgtgcaaccactcaggcagaccgtgcaaccgctcaggcgcaagcatcggcaaactctgctaccacctcgaaggctcaggctgacgagtcccttaagtgggccggtgagtcctacacccaccgtcaagcgtccgctgcgtccgctgctgcgtcccttaagtccgctcaggatgctgctgggtccaactcggctgctgccgctcagtctgctgaggctaccagacaggctggcttggcgacctctaacggtgccgctcaggtgtcccttgcgaccactcaggcgaaccgcgctaaggatgaagctgatcgtgcaaccgcgcaggctaaccttgctaccactaacggtgccgctcaggtgtcccttgcgaaggctcaagcagaccgtgcaacatctgaggctgaccgtgcaaagtccgaggctgataagctgtccggcatgaacggccttgcgaacgccattgagtcaaccacagggaacaccgttaagttcaaggatgggtgggcaataagcgcccaaggggtcacaacgaacaacttctggtcccgcaatggggcatcctttgagttcgataagggtatgatcgttcgtggtaacatcgacgttcttggcaacattgacgcgaaccaccttacatcgaaggttggctccctgaacctgaagcctgcaagcgctggggcgaacacccatgtgtggttcaggatgccggatggtgtaacagagaacgccctgatttacgtggactctggtggcaccatgcacttccgaccacgcgcacaagcagactacctcacactggcagccgatggctcagtgcatatgcgaaacaccctgcgtatcacaggaggtggggctatcatcactggccgggtaacgaccgatgaggttatgtcgaacggcactgtttgggcaggtggcggtcaatcttggatggcaactgacggcaacatctacggacctgtttggggtggatacctgtccaacaggatcgcagctaagcagaacgcgcaccacttccaagctggacgtgttggtgttggcgctccgggtggtggatatcgccagttccgagtgaacttccatgcccctatgggcggccctactgtccagatcacaatctaccgaccagcgcttcacgtagctgttggtgcccgtggtgaggcttgggtggacgggattgacgcgaacggcttcacctgctgggtccactgcgaaggtggtgcccaatgggacacttacattgactggatggccagcccttctgtgaacgttgcgggcggctaaggaggacttaatggatactaacgaaggggtggtaaaggccatccctatcgttggcgctatcggcgctgacgcaatggcaacgttacagggactgtccctcaacgacctgttctacatcgtgaccatcgtttacaccctcgtccaaatgggcctgaccgtgtggaagacgatccgtgaggaacgccggaaaaacaaggagtgacttatggcaaaacgaaacgcacttgaggtgctgctggaactgatcgacaccgaaatggctcgtgcccttctggacgaccttcgggatgatgatcgccggacacctcagctctacaacgcagtatccaagttccttgatcgacacaacttcaagctgtccagtctgatggttgaagagggcgaccttggtgagctgcaagcagcccttgacgccttccgtgacatggagctggaagaccttgatggaggccgcctgcaatgaaacagtacgcgctcaagttcctgctggtccttgggtgcgtcctttcgatctacttcatgggtctgaaggatggcgtccacaaggaatacacgcggctcactgagctgcaccaaaccgaaaccaaacgccttaaggaggcccgtgatgaagtccaatccaaactcgatgacatcgccaagcgccacgccgaagacgcacaaaggtctgaaagccttgctgctgggactgtggctgagcttcgtgatctcggtatccggctgtcagtcaaacttgccgacaccaagcgagaagccgtcgaggcatacaatcgaggcctcactgatggtcgagccgaactacacccagagactgctgaagctcttgtccgaataacacaggatgctgacaggcacgtaaaggcccttcaggagaccttgcgggaggtgaccaatgagtaaccctatgaagcccgactcgaagcacatcaagctcctgaaagggaacttcgtggccttcctgttcgtcctatgggcggccctcaacctcccggtcccgaccaagcagcagatctccatgtccaagaagctggccgctggggactcccgtcgattcatcttgcaggccttccggggcatcgggaagtcgttcattacgtgcgcctttgtggtctggaagctgtggaacaaccctgacctaaagatcatgatcgtctctgcgaacaaagaccgtgctgacgccaactccgtgttcatcaagcgtatcattgacctgttgcctttcctgcatgagctaaagccccggcccggccagcgggatagctccctgtcgttcgacgttggtcctgcacgtcctgaccactcgccctctgttaagtcggtgggtgtgactggcggcatgactggtagccgtgctgacatcctgatcgcggatgacgttgaggtccccggtaactctggaacccagtccgctcgggatcacctcggtgagctggtcaaggagttcgacgcgatcctgaagcctgacgggaccatcatctatctgggcacacctcagactgaaatgaccctgtatcgtgagctggaggaccgtggatacacgaccaccatctggcctgcgcgttaccctcgtgaccaagccgaccttgagtcctactggcacgctaagggcaaccgttcgcgtctcgatccgggtatgcttgccgagcttgaggcagatcctcgactcttctggaaacctacggaccctatccggttcgatgaggaagacctgcgtgagcgggaactgtcctacggtaagggtggcttcgcgctacagttcatgctcaacccgaacctcagtgacatcgagaagtaccccctcaagctgcgtgattggatcgtagcggccctcgacatggcctctgcacctaccacatggcaatggctcccgaacgaccgtaacgaggctaaggggctccctctggttggccttaagggcgaccgcttccaccgctatgagtcctgtgggacaaccactgctgcctacgagcagaagatcctcgtgattgacccatcgggtcgtggtaaggatgagaccggctatgctgtgctgtatcagctcaacggctacatcttcctcatggagtggggaggcttccgtggcgggtacgaggattcaaccctcatggcactggctcagataggcaagaagcacaaggtgaacgaagtggtcattgagggtaactttggtgacggcatgtacaccaagctgttcagccctgtgatgacccgtgtgcatcgttgcgcgatcaccgaggtcaagtctaagggtcagaaggaaatgcgcatatgcgacgtgctggagcctgtactggggtcccacaagctgatcgtccacgagtctgtcattgaggccgactacaggaccgcattgaatgctgacgggaccacagacgttgcctacagtgggttccaccagctcactcgactgaccaaggaacgtggcgcactgggccatgatgaccgtctcgatgccttggctatcggggtgcagttcttcacggactccatggagaaggacagcgagaagggcgcagaggaaatgctggaagggttccttgaggaccaccttgagaaccatctggtaggctacgagcacgcccgtgagatcgctttgggcgatggggtcagcattacgtgggacgatgacgatggcacagaaggatcttggatctaaacacgttagcgacacgttcgacgaagattaaaaaccctcacctaaagagggacggtgggggtcctaagtgaacatcatagaagatcttactttaggacccctgcacgtttctcgaagatccactttaaggtcactgagaatcagatctctacgaccactcattggtaggtgattattgctgcaaagcatcacctccttataggagcactgacagatgaccaagaaagctacggctaccgtactggccgtcatggtcagcctgttgaagcatcgtgctacttaccgtttccttgctgtccttctggtcgcccttggggtcaccaacggggaagccatcatggcaggcatcgagaccattgtgtgcgccttcactggctgtctcggatgagccatgcaggctcaattcaggtctgctacagcataccctcattgagctttaactcaagggtacacatcgtatccttaaaggagccctttagggtctcatcagggtcatccaccctcatgggccttcaaggtctcccttaagaatatgacataaaaattcctgacaggacctctcattgactaactccccgagtacccccataggccctccttcaggcccataacgacaccatagggcccccttaagggaatcatcaagtccagtcatctttgagggacattagggcccttggagggctccttcaggggatcgttaggggttcatggtggttccttatggtgggtgactatggggccattatgggggccttagagggatccgtcaagcccttatggttgtcctaatctgtaatggccctaaagggaaccatcaaggccaaccatcaaggga

SEQ ID NO: 24 - DNA, 20 bp, synthetic construct
  misc_feature 1..20: note = Single strand DNA oligonucleotide
  source 1..20: mol_type = other DNA
cgaggtaaccttcaggagcc

SEQ ID NO: 25 - DNA, 20 bp, synthetic construct
  misc_feature 1..20: note = Single strand DNA oligonucleotide
  source 1..20: mol_type = other DNA
tgtacagttgaggaccacgc

SEQ ID NO: 26 - DNA, 20 bp, synthetic construct
  misc_feature 1..20: note = Single strand DNA oligonucleotide
  source 1..20: mol_type = other DNA
ggcgatgtcgtaatggcaac

SEQ ID NO: 27 - DNA, 20 bp, synthetic construct
  misc_feature 1..20: note = Single strand DNA oligonucleotide
  source 1..20: mol_type = other DNA
cgaacaggcgatagcaaagc

SEQ ID NO: 28 - DNA, 20 bp, synthetic construct
  misc_feature 1..20: note = Single strand DNA oligonucleotide
  source 1..20: mol_type = other DNA
ccttgcgtaagccgcaatac

SEQ ID NO: 29 - DNA, 20 bp, synthetic construct
  misc_feature 1..20: note = Single strand DNA oligonucleotide
  source 1..20: mol_type = other DNA
attggtcgcggggtttactt

SEQ ID NO: 30 - DNA, 20 bp, synthetic construct
  misc_feature 1..20: note = Single strand DNA oligonucleotide
  source 1..20: mol_type = other DNA
cgcgccagagttctcatagt

SEQ ID NO: 31 - DNA, 20 bp, synthetic construct
  misc_feature 1..20: note = Single strand DNA oligonucleotide
  source 1..20: mol_type = other DNA
tgacgttcgcatggttgaga

SEQ ID NO: 32 - DNA, 20 bp, synthetic construct
  misc_feature 1..20: note = Single strand DNA oligonucleotide
  source 1..20: mol_type = other DNA
cgttcccgttcttgtcctca

SEQ ID NO: 33 - DNA, 20 bp, synthetic construct
  misc_feature 1..20: note = Single strand DNA oligonucleotide
  source 1..20: mol_type = other DNA
tgcgttgaaccaagcacaag

SEQ ID NO: 34 - DNA, 20 bp, synthetic construct
  misc_feature 1..20: note = Single strand DNA oligonucleotide
  source 1..20: mol_type = other DNA
cagaggtctgactcgcagtg

SEQ ID NO: 35 - DNA, 20 bp, synthetic construct
  misc_feature 1..20: note = Single strand DNA oligonucleotide
  source 1..20: mol_type = other DNA
ccagggtattgtgccaggag

SEQ ID NO: 36 - DNA, 20 bp, synthetic construct
  misc_feature 1..20: note = Single strand DNA oligonucleotide
  source 1..20: mol_type = other DNA
cgtgcaggttagctctgtga

SEQ ID NO: 37 - DNA, 20 bp, synthetic construct
  misc_feature 1..20: note = Single strand DNA oligonucleotide
  source 1..20: mol_type = other DNA
atgaactggctccagaaggc

SEQ ID NO: 38 - DNA, 20 bp, synthetic construct
  misc_feature 1..20: note = Single strand DNA oligonucleotide
  source 1..20: mol_type = other DNA
cggtatggtgccgaagctat

SEQ ID NO: 39 - DNA, 20 bp, synthetic construct
  misc_feature 1..20: note = Single strand DNA oligonucleotide
  source 1..20: mol_type = other DNA
acagcgatccaaacgaccat

SEQ ID NO: 40 - DNA, 20 bp, synthetic construct
  misc_feature 1..20: note = Single strand DNA oligonucleotide
  source 1..20: mol_type = other DNA
tctgagcgttctcgctttgt

SEQ ID NO: 41 - DNA, 20 bp, synthetic construct
  misc_feature 1..20: note = Single strand DNA oligonucleotide
  source 1..20: mol_type = other DNA
atcggaacctgaacactcgg

What is claimed is:

1. An agricultural composition comprising:
   (i) at least three non-identical isolated bacteriophages capable of infecting the plant pathogen *Pseudomonas syringae* pv. tomato, said at least three non-identical bacteriophages having the genomic nucleic acid sequences as set forth in SEQ ID NOs: 17, 19, and 21 respectively; and
   (ii) an agriculturally acceptable carrier, wherein the composition comprises no more than 10 different strains of bacteriophage.

2. The agricultural composition of claim 1, wherein the composition comprises no additional bacteriophage that infects plant pathogens other than *Pseudomonas syringae* pv. tomato.

3. The agricultural composition of claim 1, further comprising an agent which promotes the growth of a plant or maintains the health of the plant.

4. The agricultural composition of claim 3, wherein said agent is selected from the group consisting of a fertilizer, an acaricide, a herbicide, a fungicide, an insecticide, a nematicide, a pesticide, a plant growth regulator, a rodenticide and a nutrient.

5. The agricultural composition of claim 1, wherein said agriculturally acceptable carrier comprises at least one agent selected from the group consisting of a stabilizer, a tackifier, a preservative, a carrier, a surfactant, an anticomplex agent and a combination thereof.

6. An article of manufacture comprising:
   (i) a first bacteriophage capable of infecting the pathogen *Pseudomonas syringae* pv. tomato, the bacteriophage having the genomic nucleic acid sequence as set forth in SEQ ID NO: 19;
   (ii) a second, non-identical bacteriophage capable of infecting the pathogen *Pseudomonas syringae* pv. tomato, the bacteriophage having the genomic nucleic acid sequence as set forth in SEQ ID NO: 17; and
   (iii) a third, non-identical bacteriophage capable of infecting the pathogen *Pseudomonas syringae* pv. tomato, the bacteriophage having the genomic nucleic acid sequence as set forth in SEO ID NO: 21.

7. A method of controlling or preventing bacterial speck disease of a tomato plant comprising contacting the tomato plant with at least three non-identical bacteriophages in an amount which is effective at infecting the plant pathogen *Pseudomonas syringae* pv. tomato, said at least three non-identical bacteriophages having the genomic nucleic acid sequence as set forth in SEQ ID NOs: 19 and 21, thereby controlling or preventing the bacterial speck disease of the tomato plant.

8. The method of claim 7, wherein said contacting is affected at a seedling phase.

9. The method of claim 7, wherein said contacting is in the soil in the vicinity of or onto: a root, a stem, a seed, a fruit, a flower, a leaf, or any combination thereof.

10. The method of claim 7, wherein said contacting comprises dipping, spraying or fogging.

\* \* \* \* \*